United States Patent 7,745,391 (HUMAN THROMBOSPONDIN POLYPEPTIDE) - sequence listing, part 114

SEQ ID NO: 330727 - DNA, 7763 bp, Homo sapiens
  misc_feature (164)..(164): n is a, c, g, or t
  misc_feature (210)..(210): n is a, c, g, or t
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgngccgggggcgcccgccgaagctcgctgctccgggtcggggtcgggnccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggcgttggtcctggaagctgactcatcggagagggaaataccaaataaacatccgaggttgcatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgccgatgaggcccagggtgcactccttgtcagtcttgcccgttgtccctgtgcattttgctttccgctgtcaaatctcactgtctcgttttcacaccgcatcagtccccatcatcactactcctccccaaagacatacagattgccctccccggcatgaagaagtcacaattctgacccgccacctctccaggggcggtgcctgggatggccacccatcaggacagccagagccggggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggaggagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaag

SEQ ID NO: 330728 - DNA, 7706 bp, Homo sapiens
  misc_feature (164)..(164): n is a, c, g, or t
  misc_feature (210)..(210): n is a, c, g, or t
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgngccgggggcgcccgccgaagctcgctgctccgggtcggggtcgggnccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggcgttggtcctggaagctgactcatcggagagggaaataccaaataaacatccgaggttgcatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgccgatgaggcccagggtgcactccttgtcagtcttgcccgttgtccctgtgcattttgctttccgctgtcaaatctcactgtctcgttttcacaccgcatcagtccccatcatcactactcctccccaaagacatacagattgccctccccggcatgaagaagtcacaattctgacccgccacctctccaggggcggtgcctgggatggccacccatcaggacagccagagccggggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggaggagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaag

SEQ ID NO: 330729 - DNA, 2367 bp, Homo sapiens
  misc_feature (164)..(164): n is a, c, g, or t
  misc_feature (210)..(210): n is a, c, g, or t
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgngccgggggcgcccgccgaagctcgctgctccgggtcggggtcgggnccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtatgtgcactgctttacctcggcatcccccctccctgatcctgattgtattaaattaaaaaaaaaagcttccagcctcagtgtctgcagacagctcaggtatctcagaatgccttaccatggggggatctcaggg

SEQ ID NO: 330730 - DNA, 2378 bp, Homo sapiens
  misc_feature (1436)..(1436): n is a, c, g, or t
  misc_feature (1482)..(1482): n is a, c, g, or t
  misc_feature (1571)..(1571): n is a, c, g, or t
  misc_feature (1663)..(1663): n is a, c, g, or t
atgtgtctatgagaatgtgctgggtcataatcagttgctctgtgaccctggcagggttttttttgtgtttttttgttttcggaagcggtataattctgcagtggtgtgatcatagttcactgcggcttcaaactcctgggctcaagcaatcctcccacctcagaccccaagtacctgggactacaggcacaaaccactatgcccagctaattattttattttttggtagacggggtctcgctatgttgcccaggctggagtgcagtggcatgattatagctcactgcggcctgaaactcctgggctcacacaatcctcctgcgtcatcctcctgagtagctgggaccacactcacgcactgccatgcctggctaattttaaagttttttgtagagatggagtctctctgtgttacgctggccgggaactcctgggctccagcgaccctcctacgtcagcctcccaaagtgtcgggattacaggcgtgagccaccgtgcccagccccctgggcaagtttaacttctctgtgccttggactccccagtgttaaatggggtagtagagggagacagccctccgagagccttcctgccctgtgcctggcccagagcagcagtgctccgcacgtgttgcctgtttctccatctgaactgcgctcctggccgcccatggcctcccagtcattctgctccactcctgctccacacaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggtaagcgccgcgtggactgggtctccagctctgagccgttagctccctcttctggctccatggcttatggctgagcggttggactggtccccagccagctgtccctgctggctgatttctggagatgggtccccgtgtcctccccgagccctgtgccccagcatcctccctccctgacgttggcccagatgcggggggaccacctcgctggagggggcggtgcctccacagccccaaccgctgccagcttgtccccagatttccaggttcagagactgcaaaggagaaggtgagaagataggaaacaatctggaggaaggaaaggaaaagacatgagcgggggtagtgggcctgggacagcaggcgcctcttcagagtaccggagccaaacagcatctccacgcacttgcctcaggcagtggtctcttggatgtgacgccaacagaagaaagaatagacaagcccaacttcctcagaagttaagctgttgcgctacaaagaacaccatcaagaaagngaaagaacccacagaacgggagggaacacttgcagatcaggcctcngacaaggtctaacatctagaatggataaagagcacacatagcctgataataaaaagacagctcattttaaaggggacagaggctccgantagaccacaggtgcgtcttgggaaagctgggccctcgggaccagcctggctccctgagggggctcgcagcggctctgtattcctgagcaggnaggtggccctgtgtggtccccgtcctgggcaccacaagccccttgggtggtcctgtcaccctcaacaggatggctgccggcctagcagagtcccactagcaacggtgccccggagctgggcttcaaacagacatggggaggcagccctgaccttgagcgtctgctgcccttatccaacatcccagggcagaaatgaatggctttgagtctggcgtgaggcgccggaatgctggcttctcccatctggggtgggcaggctgggattcctgccccctccttcccacctgcactgtacccaggaccctttcagcttcctccgaggccgccatgggccatgctgtctgtggcgtgtgctcagtgtttcccagaactccctgtgggctcatgccccatcacccccagcgagcagccctcttcctggcacagcctcccctcctgcctcagtgccctcctgtgcttctggggacccctcccaaaggagccgtcgcctgcaaaccctttcagggtccacttccccagaacccaaaccagacatcctcaggcccctggttggtttgtttttcctctttaaaaagatcagctttaggctgggcatggtggctcatgcctgtaatcccagcactttgggaggccaaggcaggtggatcacctgaggctgggagttcgagaccagcctggacagcatggtgaaaccccatctctactaaaaaatacc

SEQ ID NO: 330731 - DNA, 5584 bp, Homo sapiens
atgtgtctatgagaatgtgctgggtcataatcagttgctctgtgaccctggcagggttttttttgtgtttttttgttttcggaagcggtataattctgcagtggtgtgatcatagttcactgcggcttcaaactcctgggctcaagcaatcctcccacctcagaccccaagtacctgggactacaggcacaaaccactatgcccagctaattattttattttttggtagacggggtctcgctatgttgcccaggctggagtgcagtggcatgattatagctcactgcggcctgaaactcctgggctcacacaatcctcctgcgtcatcctcctgagtagctgggaccacactcacgcactgccatgcctggctaattttaaagttttttgtagagatggagtctctctgtgttacgctggccgggaactcctgggctccagcgaccctcctacgtcagcctcccaaagtgtcgggattacaggcgtgagccaccgtgcccagccccctgggcaagtttaacttctctgtgccttggactccccagtgttaaatggggtagtagagggagacagccctccgagagccttcctgccctgtgcctggcccagagcagcagtgctccgcacgtgttgcctgtttctccatctgaactgcgctcctggccgcccatggcctcccagtcattctgctccactcctgctccacacaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggcgttggtcctggaagctgactcatcggagagggaaataccaaataaacatccgaggttgcatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgccgatgaggcccagggtgcactccttgtcagtcttgcccgttgtccctgtgcattttgctttccgctgtcaaatctcactgtctcgttttcacaccgcatcagtccccatcatcactactcctccccaaagacatacagattgccctccccggcatgaagaagtcacaattctgacccgccacctctccaggggcggtgcctgggatggccacccatcaggacagccagagccggggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggaggagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaag

SEQ ID NO: 330732 - DNA, 7724 bp, Homo sapiens
  misc_feature (164)..(164): n is a, c, g, or t
  misc_feature (210)..(210): n is a, c, g, or t
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgngccgggggcgcccgccgaagctcgctgctccgggtcggggtcgggnccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggcgttggtcctggaagctgactcatcggagagggaaataccaaataaacatccgaggttgcatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgccgatgaggcccagggtgcactccttgtcagtcttgcccgttgtccctgtgcattttgctttccgctgtcaaatctcactgtctcgttttcacaccgcatcagtccccatcatcactactcctccccaaagacatacagattgccctccccggcatgaagaagtcacaattctgacccgccacctctccaggggcggtgcctgggatggccacccatcaggacagccagagccggggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggaggagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaag

SEQ ID NO: 330733 - DNA, 520 bp, Homo sapiens
cagcggaacaagcaaacaaacaaacaaaaaatgggggaaaaaagtaagttaaagagccatgaatcccctggagatagattctaagacagacccatctaggctttagatgattcaacctttagaaacttctccatacttctacccactggttccctgtcttctcaagccatatagaacaaacttaatctctcttctacatgagaactctgtaattatctgaagacagatttttctcttctctctcctccccatactaagctaagtatttctatttccattcaactcaatcaacttttattagctacctaccaagtgttgggaattaggctagccagtaaagacacaagggcaaatgagccatggattctatccctcaaggaatgcccagccttgcaggggagacagctatgtaaacaggccattacagttcttaaaatcaagtgcaaaaataaagtatattcaagataaggtatgatctaataagcacaaagccaactcaactgatcccccttgcttgttc

SEQ ID NO: 330734 - DNA, 375 bp, Homo sapiens
tcagggagcatgtcgcgaaggatagggaaggacagggggtctgcttccccagccgccctccagacccccagggctggtaggggccggcaaccctatgccccaacctggcctgctgcaggtgaggggggcacaccagggtaacacaggagcaggagggggagaaagcctggctagagcatccacctcataggcaccttccttgtgtccagggtgcagatgccagggctctgaggccctgaggtcctgtctggggcgagggggcttcctccatccactgcatccactgcccggctgagtctagaggccactgagcaagcagaccctccaaagccaggcacactcaggccctcacatggtcacggtgcttatgctctg

SEQ ID NO: 330735 - DNA, 446 bp, Homo sapiens
caacaaattacctcgtggaaatggggaaggcttcatgggaaataatgtttaacttagatttagacatttaactctacttggagtgtagagatttctgtgtagacagacaaaatgattatatgagagacagaagaaactgcacaaagcaagacaagtatgtaaaaggccatgacatctctaaggtagagtgaggtaccttttgtggctgaagcacagggtctgtgagagtgtaacacagatgacattggagaagaggtagaggtgagcctagggacactgggtgccacggtatagccaagaatgggacagagtcaggaagggtaagggcaactaatatatacaaagagcatcttatctttagaaagatcattccagcaacagtaagagaataaatgatagagccagaggctgctaagggatggcaattttgagttgttgctaccact

SEQ ID NO: 330736 - DNA, 189 bp, Homo sapiens
aattagtctctgtcagcaaagtggctaattggacatgctgttaaatatgcaaataatgtatttggtttccctactcattctttttcttgggactagtcctaggtgagatatagaggagttgttgatgatgctagtggataacgttttgtgccataactaaaagtggaacactcctgatgggcttctggt

SEQ ID NO: 330737 - DNA, 682 bp, Homo sapiens
ggggccggggggcggagccttgcgggctggagcgaaagaatgcgggggctgagcggagaagcggctcgaggctggaagaggatcctgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330738 - DNA, 810 bp, Homo sapiens
aatttttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttcgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330739 - DNA, 575 bp, Homo sapiens
attatacttcttacagtgaggagccagagcttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330740 - DNA, 814 bp, Homo sapiens
  misc_feature (774)..(774): n is a, c, g, or t
  misc_feature (792)..(792): n is a, c, g, or t
  misc_feature (814)..(814): n is a, c, g, or t
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagatgctcttctctttgtttggaaacacttcantacactggtggtcttganctaatatttcttgtctgatgan

SEQ ID NO: 330741 - DNA, 743 bp, Homo sapiens
  misc_feature (10)..(10): n is a, c, g, or t
  misc_feature (25)..(25): n is a, c, g, or t
tggttcgatnatcgaccccttaggnatttgcctcgggcaagattcggcacgagcgaaggctggaagaggatcttgggcgccgccagagtctctctctgttgcccaagctggagtgcagtggcacagtcttggctcactgcaacctccacctcctgggtgcaagcgattctcgtgtctcagcctctcaagtagctgggattacaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330742 - DNA, 905 bp, Homo sapiens
  misc_feature (31)..(32): n is a, c, g, or t
  misc_feature (46)..(46): n is a, c, g, or t
  misc_feature (50)..(50): n is a, c, g, or t
agtggaagataacaaagcccataaaaaattnnaaagacaaagaaanaacncgattttcagccacttgtacctctctaagttttcatgccctgctatctcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330743 - DNA, 830 bp, Homo sapiens
  misc_feature (10)..(10): n is a, c, g, or t
  misc_feature (25)..(25): n is a, c, g, or t
  misc_feature (725)..(725): n is a, c, g, or t
tggttcgatnatcgaccccttaggnatttgcctcgggcaagattcggcacgagcgaaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgtgccgcctgctgctgatgctaccctctgtgggtacccgtgccccagaggacgccgagcttcagccccgacccctggacatctactctgccgtggatgatgcctccacgagaaggagctgaatcgacngcctgcagaagtcttggagagcctcaagagataacgttgttccatctattgtaagaagtttggccagatcccctgtgtgaagcccgttaacaatgtgccttgagg

SEQ ID NO: 330744 - DNA, 508 bp, Homo sapiens
  misc_feature (360)..(360): n is a, c, g, or t
tcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtctaagagtgaagtaggtgtgacttgaactagattgcatgcttcctcctttgctcttaggaagaccagctttgcagtgacagcttgagtgggttctctgcagccctcagattatttntcctctggctccttggatgtagtcagttagcatcattagtacatctttggagggtggggcaggagtatatgagcatcctctctcacatggaacgcttgaggcatgccaaatgttccatatgtgggtgtcagtcagggacaacaagatc

SEQ ID NO: 330745 - DNA, 439 bp, Homo sapiens
gcttcttctactcaccgccgccggggcctgaggtggttgcctcgcccctggtcccctgcccctcgacccccaggctcgcctctgcctcccacccggaggagctctgcgagctggagatccggattaaggagctggagttgctcaccatcactggggacggcttcgactcccagagctacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaaaaacatgg

SEQ ID NO: 330746 - DNA, 2045 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactcaaaacaccgaaccaataacaaacaacactgttgcgcccctccggccctcaaaagttttaaaaccctgttgggccgcggccccagggcatacaac

SEQ ID NO: 330747 - DNA, 2134 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactcatagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcag

SEQ ID NO: 330748 - DNA, 2040 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccccctgaaaccattaggggacaacattaaggaaacagcttgccctctactcaaaaaacgtttaggcaaacagacacacccacaccaacaaacaacccccacacgccccacacacacacacagagcaaa

SEQ ID NO: 330749 - DNA, 1997 bp, Homo sapiens
ggggccggggggcggagccttgcgggctggagcgaaagaatgcgggggctgagcggagaagcggctcgaggctggaagaggatcctgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330750 - DNA, 1602 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacaggcccaagatgagggtaccgagctcgaat

SEQ ID NO: 330751 - DNA, 2125 bp, Homo sapiens
aatttttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttcgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330752 - DNA, 1914 bp, Homo sapiens
aatacggctagtacgaggccggtgttaatcggccgaggagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330753 - DNA, 2014 bp, Homo sapiens
aatttttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330754 - DNA, 2058 bp, Homo sapiens
  misc_feature (10)..(10): n is a, c, g, or t
  misc_feature (25)..(25): n is a, c, g, or t
tggttcgatnatcgaccccttaggnatttgcctcgggcaagattcggcacgagcgaaggctggaagaggatcttgggcgccgccagagtctctctctgttgcccaagctggagtgcagtggcacagtcttggctcactgcaacctccacctcctgggtgcaagcgattctcgtgtctcagcctctcaagtagctgggattacaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330755 - DNA, 2264 bp, Homo sapiens
ttaacactttttaaaaattaatggactgggtttttcaggtttttttctgaccattcttgagcatatatcttatacatagctttggctgggcatggtggctcacccctataattctatcactttgggaggctgaagcaggaggaccacttgagcccaggagttcaagaccagatgaccgggcaagaaagtgagaccttatctctctaaaaaaaaaaaaaaagaagaaaaggaaaaaatccccaagtaacttcatagcataaattctaaaagtggaattgctggatcaaagggggcatgtgtttaaaatcttggcagatattaccaaatttccctcttaacagtataaatgcctgttcctcctccgtcccacccccataactatactggctctgatgagaccttggttttctgtaaaagctctatttagaggtgtatcattatttacttaattgttctcctttacaacccacctgggatgagcatcttgcctagaagtctctacttgcacaggatacatacgaaatagaattgaggattcaaaagcagatacagaactcttcccacttactttcttacccttgtgtgtgtctccccacaggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330756 - DNA, 2119 bp, Homo sapiens
ggggccggggggcggagccttgcgggctggagcgaaagaatgcgggggctgagcggagaagcggctcgaggctggaagaggatcctgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgagttgggatatcactatgttgcccaggctggccgcaggcaatcctctcacttcagcctcctaaagtgctgggattacaggtgtgagccatcacactggcctcattgtccatattttaattggggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330757 - DNA, 1893 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgagtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330758 - DNA, 1788 bp, Homo sapiens
  misc_feature (10)..(10): n is a, c, g, or t
  misc_feature (25)..(25): n is a, c, g, or t
tggttcgatnatcgaccccttaggnatttgcctcgggcaagattcggcacgagcgaaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctgggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330759 - DNA, 1263 bp, Homo sapiens
tgatgatctgaggaggtatcagtagacagtccacctcacacgatctttacctttcacttcatctgccttcattatgcagccctagcagcactccacctcctattctgcacgaaacgggatcaaacaaccccctaggaatcacctcccattccgataaaatcaccttccacccttactacacaatcaaagacgccctcggcttacttctcttccttctctccttaatgacattgcaacacggtctctcatggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330760 - DNA, 2324 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctgaaaaaaaaaaaaaaaacaaaaaaaacaaccacccaacaacaaaaaaaaaaaaacaaaacaaaaacttgtgttgggcgcgcctcggcgcccccgaaaaagagttttccaaacaccacttggggggggcggcgggggcgccccagatggagttcgctagaaaagtgggcgcacgagggtgtccccccgagaagacacccgcggcacatagaaacagtcgggcggcggggtggttcccaccccaaataaaaaaaaacgggcggggggggaacccacacgcagctcgtgttcgagagaccaaacacacagcagggggggcgacgcagggacgacgacagggcggctcatcacccgaaggaaggacccacagcgcgcggcgtcacggatataattatcgcccgcgcccgcggcggctgcagaagcacagagagtgacaagacagaagcagctacacaaagcaacatcagaacagacgaggacaaaaggacgagagggaaacaagggagggaggagaacagagaaagaaaaggaagagagacaaaagaagaggagagcaggaaaaggaaggcaaggaaccgaaagaaaagggagacaagagcgcaaaaggacaggagcaaacaggagaagcgaacgaggaagagcagagagcagggagcaagagcaaggaaaggacgagccgagggcggagcgaacagacccacgccagcaagaatgagaacggaagaagacagagaacagcagaacgggagagaagggagagagaggagaagcaggcggcaggacagagagaggaccgaggcgagggagggagagcagcgggaaggcaagagagaggagaggacgagagacgagagaggacggagaacaagaggagagagaggaggggaggcgaggagcgagagaggcagacggcgcgaagggaggaggagagggagaggaggagaagaagagagagcaggaggaggcagagacaacggggagagggggagagaggagagggagcaagaagagaaagaagagacacggaggagaaagaagcagagaagaaagagaagagaggcaaaagagagcaagagggaaaaaagggagacaacggacggaatgagaaggaagaggaagagagagaggagagagaggagaggagggagcgcagaggagaaggaagaagggagacgaggagaagacagaacgaggaagggaagaaaagaagaagaggaacgagagagagagaaggagacgcgaatggagaggaggtaggagcagacagaagagaggagaggaacggagagaggcagaggaggcggtagaggagaaacaaagagaagaggaagcagaaacgaagaggaaagagagagaaagaaagaaagcagagagcacgaacggagacgagagcagaggacagcacgacgatcgagacagagcagacgcagacgggagagaagactaagagcacacgaggagcaagaaatagagacgaaaagcagaaacaaaaggagaaagaacagaaacagactaaaacgagaaaaaaagaggaccacaaagagagaagaacggagaggcagaaaacaagagaaaacagagacaggaagacaaggaaacgaggggacacaagaacgacaagcaaacaacaacgagcagagaagcaaaaagaagacagaggaaaagagaagaggaggagaagagagaaaca

SEQ ID NO: 330761 - DNA, 2290 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctgaacaacaaaaaaaaaaaaacaaaacaaaaacttgtgttgggcgcgcctcggcgcccccgaaaaagagttttccaaacaccacttggggggggcggcgggggcgccccagatggagttcgctagaaaagtgggcgcacgagggtgtccccccgagaagacacccgcggcacatagaaacagtcgggcggcggggtggttcccaccccaaataaaaaaaaacgggcggggggggaacccacacgcagctcgtgttcgagagaccaaacacacagcagggggggcgacgcagggacgacgacagggcggctcatcacccgaaggaaggacccacagcgcgcggcgtcacggatataattatcgcccgcgcccgcggcggctgcagaagcacagagagtgacaagacagaagcagctacacaaagcaacatcagaacagacgaggacaaaaggacgagagggaaacaagggagggaggagaacagagaaagaaaaggaagagagacaaaagaagaggagagcaggaaaaggaaggcaaggaaccgaaagaaaagggagacaagagcgcaaaaggacaggagcaaacaggagaagcgaacgaggaagagcagagagcagggagcaagagcaaggaaaggacgagccgagggcggagcgaacagacccacgccagcaagaatgagaacggaagaagacagagaacagcagaacgggagagaagggagagagaggagaagcaggcggcaggacagagagaggaccgaggcgagggagggagagcagcgggaaggcaagagagaggagaggacgagagacgagagaggacggagaacaagaggagagagaggaggggaggcgaggagcgagagaggcagacggcgcgaagggaggaggagagggagaggaggagaagaagagagagcaggaggaggcagagacaacggggagagggggagagaggagagggagcaagaagagaaagaagagacacggaggagaaagaagcagagaagaaagagaagagaggcaaaagagagcaagagggaaaaaagggagacaacggacggaatgagaaggaagaggaagagagagaggagagagaggagaggagggagcgcagaggagaaggaagaagggagacgaggagaagacagaacgaggaagggaagaaaagaagaagaggaacgagagagagagaaggagacgcgaatggagaggaggtaggagcagacagaagagaggagaggaacggagagaggcagaggaggcggtagaggagaaacaaagagaagaggaagcagaaacgaagaggaaagagagagaaagaaagaaagcagagagcacgaacggagacgagagcagaggacagcacgacgatcgagacagagcagacgcagacgggagagaagactaagagcacacgaggagcaagaaatagagacgaaaagcagaaacaaaaggagaaagaacagaaacagactaaaacgagaaaaaaagaggaccacaaagagagaagaacggagaggcagaaaacaagagaaaacagagacaggaagacaaggaaacgaggggacacaagaacgacaagcaaacaacaacgagcagagaagcaaaaagaagacagaggaaaagagaagaggaggagaagagagaaaca

SEQ ID NO: 330762 - DNA, 638 bp, Homo sapiens
  misc_feature (609)..(609): n is a, c, g, or t
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggattccatttgngggattccatttgagggattccatttgag

SEQ ID NO: 330763 - DNA, 826 bp, Homo sapiens
catacagcttggaagcacatagcatcgaagacgctcgcttcagaaatgtccctgactgctgcggcctccactatgtttcgaatgacgaatttcttaatggccttgtccttgggcacgcatcgggcacagttagtgcagcgaataggctgcacgtgccgcggccctttttggcacgaccattgttccttcttttctttgtcatcttggaggcacgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330764 - DNA, 937 bp, Homo sapiens
acggatagcggatctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagatccgctatccgtcgacggatagcggatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330765 - DNA, 566 bp, Homo sapiens
tatactctgttggacaaacaagggttttttttcaacattaatcaagaaattcctccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330766 - DNA, 773 bp, Homo sapiens
ggggccggggggcggagccttgcgggctggagcgaaagaatgcgggggctgagcggagaagcggctcgaggctggaagaggatcctgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgatacccatcccctcagaggaggaggacaggacagttatgcctgcagttataaactgagaagtgttgtgttccaagctctgcatggaattggggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330767 - DNA, 544 bp, Homo sapiens
aatttttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttcgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctggtacaggtttacaagttggaggtggcatgcaattcacgcggtcaacccgttgggaaagcacgccactctcagaggccttacttacg

SEQ ID NO: 330768 - DNA, 637 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330769 - DNA, 670 bp, Homo sapiens
  misc_feature (10)..(10): n is a, c, g, or t
  misc_feature (25)..(25): n is a, c, g, or t
tggttcgatnatcgaccccttaggnatttgcctcgggcaagattcggcacgagcgaaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330770 - DNA, 730 bp, Homo sapiens
ggggccggggggcggagccttgcgggctggagcgaaagaatgcgggggctgagcggagaagcggctcgaggctggaagaggatcctgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatgacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaaaaacatgg

SEQ ID NO: 330771 - DNA, 800 bp, Homo sapiens
ggggccggggggcggagccttgcgggctggagcgaaagaatgcgggggctgagcggagaagcggctcgaggctggaagaggatcctgggcgccgccagagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330772 - DNA, 601 bp, Homo sapiens
acgctttcataaacttcagggatcccgtgttgccatggaggcatgccaaatgttccatatgtgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctg

SEQ ID NO: 330773 - DNA, 1952 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330774 - DNA, 2260 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccaaaaaaaaaaaaaaaaaaaaaaaaaaaaaaaaaaaaaaaaaaaaaaaaaaaaaaaaaaaaaaaagaaaaaaaaaaaaaaaaaacaaaacaaaaagaaaaaagcaaaaaaaaaaaaaaaacaaaagagggaccggcagcccccatcgaaatactcctccagacagaccaaaataacaccacaccaatttatgagaaaagagcacccacaatagaggactacaaaagccacgagagacagcaacacacaaaccacaccaagccgaaccacagaaacgaagaacaaccaaaacacagtgcagcgaggcgctgccagcgagccgacagccaccacacataccggcggcgggacacgacaaacacgccagccccccaccaccacccaaggcggatgaccaccaccgcgcgcgccgaaaaaataaccaaccagcagccacggaggcgcaacaacagcatatcaccgcggccgaaaaatgcgcgacgagaacaaaaaaatagg

SEQ ID NO: 330775 - DNA, 1985 bp, Homo sapiens
  misc_feature (10)..(10): n is a, c, g, or t
  misc_feature (25)..(25): n is a, c, g, or t
tggttcgatnatcgaccccttaggnatttgcctcgggcaagattcggcacgagcgaaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330776 - DNA, 1890 bp, Homo sapiens
attatacttcttacagtgaggagccagagcttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330777 - DNA, 1949 bp, Homo sapiens
aatttttgactcactgaccctgatggggaagatagtgttattcccacagtgtggtagtacacactggggcttatagggactgagcctactcaagggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330778 - DNA, 2073 bp, Homo sapiens
tcaaacaccataattgagagcagcaaaattaaccatgtgtcaggcactgtattatgtactctaaacccatcattttaaaaatcaatccaatagcctgctgagattggtgatattacttcccccactaacgctaaggaaaccgattctcagagaggttaagttgcttgctcaggtcacacagctagtaagtgaattcgcgttggcgcactgctatatcgcgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330779 - DNA, 1721 bp, Homo sapiens
cgagtcgccctgtatcatctatggattttgatgcgtgtctcattaccacagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330780 - DNA, 1744 bp, Homo sapiens
gtgggttgaccgtggcttgtgggttgaccgtggcttgtgggttgaccgtggcttgtgggttgaccgtggcttgtgggttgaccgtggcttgtgggttgaccgtggctttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330781 - DNA, 989 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtagacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaaaaacatgg

SEQ ID NO: 330782 - DNA, 815 bp, Homo sapiens
  misc_feature (14)..(14): n is a, c, g, or t
  misc_feature (98)..(98): n is a, c, g, or t
  misc_feature (112)..(112): n is a, c, g, or t
  misc_feature (135)..(135): n is a, c, g, or t
  misc_feature (166)..(166): n is a, c, g, or t
  misc_feature (169)..(169): n is a, c, g, or t
  misc_feature (177)..(177): n is a, c, g, or t
  misc_feature (186)..(186): n is a, c, g, or t
  misc_feature (199)..(199): n is a, c, g, or t
  misc_feature (245)..(245): n is a, c, g, or t
  misc_feature (279)..(279): n is a, c, g, or t
  misc_feature (282)..(282): n is a, c, g, or t
  misc_feature (291)..(292): n is a, c, g, or t
  misc_feature (299)..(299): n is a, c, g, or t
cggccacgggaatnggggattgatgcagacagcaatgggggtggggaaatcgagtggtctcgggccgggtggtgatggtgaaggtggaggtgagcggngctgggccacacanatgacagagggaacactcgacgncatgggacgggcaggatgaagtgtgcgtagnggnaagggganggttagaantgcagtgcatgtngggggggagagagttggaaggcaggggtacacccgggtgggggganagggggatacggccaaagggctatccggaagaanaantgttcgtcnnggggatnggggacatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaactca

SEQ ID NO: 330783 - DNA, 685 bp, Homo sapiens
ggggccggggggcggagccttgcgggctggagcgaaagaatgcgggggctgagcggagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatgacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaaaaacatgg

SEQ ID NO: 330784 - DNA, 841 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaa

SEQ ID NO: 330785 - DNA, 922 bp, Homo sapiens
  misc_feature (873)..(873): n is a, c, g, or t
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaaccgggggcttttcggggggaaaggtgaagggnggccgttctccctcgcagggaatgcggcctagggtatcgatggatccgc

SEQ ID NO: 330786 - DNA, 946 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaaaaaaatttgtggggggttgggcctggaaaaagtttttaaaaccattcggtgggggggggcgcccatgatgtttggggacagggggaaaagggggcccaagaggac

SEQ ID NO: 330787 - DNA, 700 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattt

SEQ ID NO: 330788 - DNA, 467 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacagagctaggagatgtggagaaagcattggttcaacactaatgcatctacacgattagtttgtgaaggtg

SEQ ID NO: 330789 - DNA, 1225 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaaaaaaaaaaaaaaaaaaaaaaaaaaaaaaaaaaaaaaaaaaaaaaaaaaaaacaaacaaaagaaaaaaaaaaaaaaaaaaaaaaaaaaagggagaagggcgaaggaagaagaaagaaaaaaagaaaaccaaaaaacagagggagagagagggaggagacaaaagagaggaagaaaacagacagggaaaacagaagaaggagagaaacaccgggaacaaaaagctaagggcggtaggagaacacgaaaaaaaaaaacaacgggggagggggaggaagaaaaggagaggacgacgaaaacacagaagagagagagaaacaggaggagcgaacgggcgggaccaataaccagaggagagaccaccaaaagagcagcaaaacagaaaag

SEQ ID NO: 330790 - DNA, 597 bp, Homo sapiens
  misc_feature (570)..(571): n is a, c, g, or t
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcnnacggtccggccatacgtgtccggcca

SEQ ID NO: 330791 - DNA, 615 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaa

SEQ ID NO: 330792 - DNA, 783 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaa

SEQ ID NO: 330793 - DNA, 5226 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacaga

SEQ ID NO: 330794 - DNA, 3917 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttaccttta

SEQ ID NO: 330795 - DNA, 3712 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgc

SEQ ID NO: 330796 - DNA, 3800 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagacgtaaagttccgttggggatcctcagct

SEQ ID NO: 330797 - DNA, 5027 bp, Homo sapiens
atctcagtcctcctcctcttccagggccgtctgccgggatctcctccccttctaaacctggtcctccagcggctctggcgccttggtaggcatgcactctttggcgcctcgtacgtccactgtgcggagccgctcctgtctggactttcccctgggaacagaaagggagctcacttcccgccagcttcacctcttaggttgcggcctgcgttgtgatttctggggttagatttcactttgctacccacccccactccgatctcaagttcctagtccccaacctctggttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacaga

SEQ ID NO: 330798 - DNA, 4636 bp, Homo sapiens
ccaaagtgctgggattacaggcatgagtcaccacacctggcccagtctttgttattgagatggagttttgctgagaaattatttttatatcttttaattaaaaggttctcatgattaggggaacagctaattttttgatacctctggttgaaaaattacaattgcacacatgactaggatgcagaaactttgctcacaaatgttactctagcctgtaagtctttattcttcattgtttgaaatagctagcaaagattctctaaaagcaatatactcagctttgttcctgcaggaatgatcagtctaaataaatatattgtacggtgatgctgcatttagtttttctaaataggtgcatttttaaatgatgatagtacactgaatcatgatttcaggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacaga

SEQ ID NO: 330799 - DNA, 3356 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgat

SEQ ID NO: 330800 - DNA, 5515 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgtttttttttacaaaaaaaaaaaaaaaaaaaaacaaaaaacaacgtgtgtgtgggggccggcactcgcggcccctctcgaaaaagagctttcttataaaccacattcgtgtttgtggggcggcggggggcccccgtggtagtgtttacggtgtgaacacgtgtggctcatatgaggtgtgtttccccttagagagaacctcgcggggccctagagaccatatagggcgtgcgggcgaggtttcctctccaccacatatattaaaataaagcgcgcgccgggggggggaaacaacccagagagggtgtttttttttgaagaaaaattctcccacaaatatgagagagtttctgaggaggtgtcctacttaaacgggggagtctctcttctacacacaaagcggagagtgtcccacaaagagagagagtctgcgagttttctccaaatattaaccgcccccgcttgtggggtgga

SEQ ID NO: 330801 - DNA, 5146 bp, Homo sapiens
aggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaactcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcgggttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacaga

SEQ ID NO: 330802 - DNA, 515 bp, Homo sapiens
gtgtgtataggttctaagcacctaaacagatattcgctccacgctgcgggtgggctctctccacagagagagatcaccaccattcatggatcaccacctgtggatcaccaccattcatggatcaccacctgtggatcaccaccattcatggatcaccaccatgttcaatggatgtcaccagccatgttgatagtgactcaccacgatgtggatatctaccagcacagtataacatatgtgatgtcagcagcgtgatgctaacttagacagcaggtggcaatggcatattatgcccttgctgctggacgtcatgaatgcacgtgtccatcggcagttctacacataagctggtgtgacgatctcagccctagccatgtcctctcaactcctctctgccttgctggccttccaccaccagtgctgcgtacacagttctctacgtcccatgctggctcgcatgctccacaatcgatggagctcaggaccccgcgtgcacggatggcccgagctccatc

SEQ ID NO: 330803 - DNA, 273 bp, Homo sapiens
cttctacacaaattcataataacatattttatttgcatttggatagtttcatgtaataattaaacaagataaaaatattagagattgttgtacctttaactcatcatatcagctgaccatatttgagagtttactagctatttttcccaaaaggtacttcaacataaaattgaatacataacattggataactattgataacaagggcaacaaaatggaagcatccacgaggatggatggattagcccttggaaaacattttttttgccctag

SEQ ID NO: 330804 - DNA, 262 bp, Homo sapiens
aggtgtgagctactgtgcctggcttgaactgattaagttcgggtagttgagatttggagagaataaggaagtggccaggggtggtggctggcaggtggacaagcccaggtgtgatttccaggacttgatgctgacacctgtggaggaaggctcaccatgagacgaatgctgcgaggatgctggatgcacttcttccctttttatctctccagcggccccgtgaggaggtagccattgctatccctgttttagatgatgaaat

SEQ ID NO: 330805 - DNA, 750 bp, Homo sapiens
gtcagggcttatatgaggaaatctccaagaaacattcctggacattgcaatgcatcattgtacaaatttgatgaaagattttttttggagaaccaagttcaggaggcaggggaagaagaactattagaaaggaacactaataaattttttcttagctcttttaagaaagtttaatagtttgaagttgaaaatagtttaatagcctaaaaatagtttgagataggtgagatagttgaaaataggtgaaaggttgctaagaaaataacagataataagaattacaaataccttattaaaaatataaaaatatacccaggctcacaaataattaaaggaaaggaataaaaacaatagtaatatatcatttttcatctgtcagacaagtaaaatcaagaaagattagtaataccctttattgtcaaggtgagggtaaataaagtctcaagtgtccagggagaaacacacagggtgttcttcacagttttgtttgaaaaaaacaaacaaaataggccaggcgctgtggctcacgcctgtaatcttcctttctaatagatgtcattcgccaagggatcacatctatggtgtcgttaaagttccctctccttggggtttagatgatgtcctcaggccctgcttttgttctgggttcatgtcagtttttcattttgtgcattattttcatctggatttctagatacccttacaactctaaaaacgctgttgttttgggccctaaagtgctataattaa

SEQ ID NO: 330806 - DNA, 493 bp, Homo sapiens
cctgtctcaaaataaataaataaataaaaatctccttgcttatcaagtttctattctgtttatttctgtctattctctttttgtctcttttttggggtctgtgtattattacaaggagaaagctcattttacttaaagatgactctttgaattcaaaagtataaagacaagaaaaagtaaaaggcaaattatataaaaaatcaattttgaaatgtttctttgaatataattcctaaaaggaaaaaaaattaataagcaaaagtaacctactttttcacagctcaaattttaagactgagacctgttaaaaggatacagttcaaagaattatatttgatgaaaagggtagagatgttcagtcatacaccattaactaaaactattcaccagtaagaatattttcaaacatcactcacaaaatatctatgtggcatataacaaaatgagcaaacaatcctaatggtaagatttgtatagattttcctcacttcac

SEQ ID NO: 330807 - DNA, 683 bp, Homo sapiens
gtgtagaacccttttctcaggcaaaacctaacatctgaccgcaccctttttgctattaaaaaaaaaaaaaagcttctatttttttcctcctgtcgttaagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaagggaaaaacttaaaatggatatgaaaagtgaagaaagtgatcataggagaaaaccatttcaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330808 - DNA, 452 bp, Homo sapiens
ctttttattaacaagttgatgagatgagcattagtatacctataggaagtttttgaatgagtgccaattctgaatttacaaatcaacatttcttctctccagctttctttagcttgcccatggtgatgtgaagatgagaagaaatagcaaggcccaaccagttcttcatctggagacagttcaacgttctgcaaaccaggtaaaaataatacagacgattttaggaatgcatagtcactttataaaataaactattttctttctcaagtttgatctacagatttttgcagaagctatatttatcatctaatgtataacttgttaataaacatgacattgtatcaatttcgattatctgtgaagagcagagtgactaaagcatgcatttgtgcattgactcattaataaagttatagttgtagtataacttacttttataaaaatattttaaa

SEQ ID NO: 330809 - DNA, 419 bp, Homo sapiens
caactgttgctttttcatgatttcaggaatttcgcttgggggggggaatttaaattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaagggaaaaacttaaaatggatatgaaaagtgaagaaagtgatcataggagaaaaccatttcagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330810 - DNA, 376 bp, Homo sapiens
tctcatgttgttgcttttatcattatgaattccttgcttgttgccacctaagatacgatggagcaagcacagtcttaaagaagatttgctgattttttgtttttctcagcagaccagagacatccataaaaattcatcagagagcattttactactgagctgcaaagggaaaaacttaaaatggatatgaaaagtgaagaaagtgatcataggagaaaaccatttcagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330811 - DNA, 1149 bp, Homo sapiens
gtgtagaacccttttctcaggcaaaacctaacatctgaccgcaccctttttgctattaaaaaaaaaaaaaagcttctatttttttcctcctgtcgttaagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaattgtcagtttgaatttttctttcatactattacagtttatattttactataggcagaatttcctctttatcctaaattttgatattctccataatttcatcgtgccttgacattgctgtatataatttctatacatcaggaaggcaattctgtgtgcatgtgtgtgtgtatatatatagttagaagttagaaactgaaactcttttttgtctaccatcatttcatatttttcttgctatttcaaacctataatttttaaagaaacgactaacgtaatcattcatagaatatgctgtcagtaacttaacaatataaatgttaacatggaggcatttagttcagcatttgctttacttaatagagtgcagaaaatgtggcccttttctcagttagggtgtatgtgaagataaatttagaatttctagactagtaaatacttctctgataataacttaattatagctatttcaaaccaaattgtttaattgtggtgaatcatatgtaaattgttcagatgtaggtcaacacccacgcccacattctagcacctctttcctaattcaagacaactttgcagtgcctaaaagagctgaacagtgcagattagagacataagacaaaaaaaa

SEQ ID NO: 330812 - DNA, 1407 bp, Homo sapiens
tgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattgctttctttagcttgcccatggtgatgtgaagatgagaagaaatagcaaggcccaaccagttcttcatctggagacagttcaacgttctgcaaaccagatgaaatagcaaggcccaaccagttcttcatctggagacagttcaacgttctgcaaaccagatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaattgtcagtttgaatttttctttcatactattacagtttatattttactataggcagaatttcctctttatcctaaattttgatattctccataatttcatcgtgccttgacattgctgtatataatttctatacatcaggaaggcaattctgtgtgcatgtgtgtgtgtatatatatagttagaagttagaaactgaaactcttttttgtctaccatcatttcatatttttcttgctatttcaaacctataatttttaaagaaacgactaacgtaatcattcatagaatatgctgtcagtaacttaacaatataaatgttaacatggaggcatttagttcagcatttgctttacttaatagagtgcagaaaatgtggcccttttctcagttagggtgtatgtgaagataaatttagaatttctagactagtaaatacttctctgataataacttaattatagctatttcaaaccaaattgtttaattgtggtgaatcatatgtaaattgttcagatgtaggtcaacacccacgcccacattctagcacctctttcctaattcaagacaactttgcagtgcctaaaagagctgaacagtgcagattagagacataagacaaaaaaaa

SEQ ID NO: 330813 - DNA, 1231 bp, Homo sapiens
ctttttattaacaagttgatgagatgagcattagtatacctataggaagtttttgaatgagtgccaattctgaatttacaaatcaacatttcttctctccagctttctttagcttgcccatggtgatgtgaagatgagaagaaatagcaaggcccaaccagttcttcatctggagacagttcaacgttctgcaaaccagatgaaatagcaaggcccaaccagttcttcatctggagacagttcaacgttctgcaaaccagatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaattgtcagtttgaatttttctttcatactattacagtttatattttactataggcagaatttcctctttatcctaaattttgatattctccataatttcatcgtgccttgacattgctgtatataatttctatacatcaggaaggcaattctgtgtgcatgtgtgtgtgtatatatatagttagaagttagaaactgaaactcttttttgtctaccatcatttcatatttttcttgctatttcaaacctataatttttaaagaaacgactaacgtaatcattcatagaatatgctgtcagtaacttaacaatataaatgttaacatggaggcatttagttcagcatttgctttacttaatagagtgcagaaaatgtggcccttttctcagttagggtgtatgtgaagataaatttagaatttctagactagtaaatacttctctgataataacttaattatagctatttcaaaccaaattgtttaattgtggtgaatcatatgtaaattgttcagatgtaggtcaacacccacgcccacattctagcacctctttcctaattcaagacaactttgcagtgcctaaaagagctgaacagtgcagattagagacataagacaaaaaaaa

SEQ ID NO: 330814 - DNA, 941 bp, Homo sapiens
tgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattgctttctttagcttgcccatggtgatgtgaagatgagaagaaatagcaaggcccaaccagttcttcatctggagacagttcaacgttctgcaaaccagatgaaatagcaaggcccaaccagttcttcatctggagacagttcaacgttctgcaaaccagatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaagggaaaaacttaaaatggatatgaaaagtgaagaaagtgatcataggagaaaaccatttcaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330815 - DNA, 557 bp, Homo sapiens
caggggcagaaaatagcacacttttactctacgcaactgttgctttttcatgatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaagggaaaaacttaaaatggatatgaaaagtgaagaaagtgatcataggagaaaaccatttcaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330816 - DNA, 568 bp, Homo sapiens
gtgtagaacccttttctcaggcaaaacctaacatctgaccgcaccctttttgctattaaaaaaaaaaaaaagcttctatttttttcctcctgtcgttaagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaagggaaaaacttaaaatggatatgaaaagtgaagaaagtgatcataggagaaaaccatttcagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330817 - DNA, 826 bp, Homo sapiens
tgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattgctttctttagcttgcccatggtgatgtgaagatgagaagaaatagcaaggcccaaccagttcttcatctggagacagttcaacgttctgcaaaccagatgaaatagcaaggcccaaccagttcttcatctggagacagttcaacgttctgcaaaccagatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaagggaaaaacttaaaatggatatgaaaagtgaagaaagtgatcataggagaaaaccatttcagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaa

SEQ ID NO: 330818 - DNA, 976 bp, Homo sapiens
gtttagcagttccacgtctccaagggacattttcaaatgtatgtaaagaaatggttacagatttttaagaagcatcttccatgtccacatcctgttgtaatctctgtgccattttctcttccagctgcttccctttgcctacaagaggggctcggaaagatggatgtttttcttgacttctttgatatcctgaacttctctacgtagccctttatgtttcttcagtctgttcattataaatttagcttggcatttctgtttgatctcttcaactctcttcattggcatcaatagttttattccatagctctcactggatatttgataagtgcatttctatgtttttccaattcaaatgaattatccactgtaagccctttaccagctgttttccagaatgctttggtccacctacctttgtgaggattgtgcttctttttaaagtttttatgacatttagatttacaaaatctgaacaccttgcaatcattgcggacagacatcatgccatggccagggtagatgggccccgaacagaaataacactcttgagacacatgttgaacccacgtgggtccccaccgaccaaacgccaggcttgagaggaagtcaggtgtatgtttaacctaaactgccacactcttttctaaggtggtgtatcattttatgttaccatcagcagtatacaagagtgccagttcctttacatcctaataacacttggtatggttaatatttttaattttagccattcttacaggtatataacatcttgtgattttaatttctatttccctaatgacatgttgcacatcttttcatgtgcttatttgttattgttggtgacaaatgtatcttctttggtgaagtagatgttcaaatttatgttcatttgtattgggtttggagttattgtcaagttttgagagttatttatgtattctgcagacaagtcctttatcgataaatgctttgc

SEQ ID NO: 330819 - DNA, 186 bp, Homo sapiens
atggagcatgggcttgctggcagcgccaacttctcctcatcctcaccgccatctatttcaggtatcctgagcatgattatcattcggaccctccggaaggacattgccaactacaacaaggaggatgacattgtacgaggtcttggctggggagggatgaagttggatggggaggggaggaggacc

SEQ ID NO: 330820 - DNA, 3786 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330821 - DNA, 2345 bp, Homo sapiens
acagtgtggctcaccccctgctctggggaagaggggccagagccacatgccaggcccacgggccctgatggtgtcatgatgatgtgtccactcctgcccttgtgacaggttggtgtgccaggggaaggggagcagggtggtcaagccagctgaagccccactgtgtgtccacaggctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330822 - DNA, 2523 bp, Homo sapiens
gctggctaagggtccctctttctggagggcctgcacaaatatccaagcatcaagcctcccgggtgatacatccgaacgtatgtgccttttttcccgccctgaactctttgtgggaatgaaattcccaccccaactgctgccattcaggtgaactcaattctggcttttgtgcttgaagtgactgctgggggaagaacgctttggttctgccaagtataaactttggaggatgaagggacaggagactatcaacgttcgacgaccctgagttctcactgctcctcgtgaagacttccttgtagacccgtgccaaactgtcttgtagaagcacatgtggttttaggtttggtatcatctgttgctgttctgactggtggctctgacacctggtgccttctcccacagacagagatgctacagaccctgatgcatccactcttaattttttggaacgaccgtctgtagactctcctcctctccatccttggcttcggatttcattgtgcaaggttttacactgacttatcgaagttcccgttgccatcttttatttcggtaccagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330823 - DNA, 2024 bp, Homo sapiens
cctaggctaggtacgaggccgggtgttaatcggccgagggccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330824 - DNA, 2136 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgta

SEQ ID NO: 330825 - DNA, 759 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccattatctctcttaccctgttttctcgttttgagggggaattccccaatactacagtgtttggggtcc

SEQ ID NO: 330826 - DNA, 535 bp, Homo sapiens
ccttccaggttcatgccattctcctgcctcagcctcccgagtagctgggactacaggcgcctaccaccatgcccagctaattttttgtatttttagtagagacggggtttcaccctgttagccaggatggtctcgatctcctgacctcatgatccgcccgcctcggcctcccaaagtgctgggattacaggcgtgagccaccgcgcccacctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330827 - DNA, 455 bp, Homo sapiens
tggcggggcattctgggcaaaaaggatagcttgaagaaaggcgtgctgatgagaacatagtgaggccaggagccaactgaagcagcagatagccagaggtggagccacaggcagcccttggacacatgagctgagaagtcagtaggaccaagcgatggaacagctgggatgctcctctccccaggatacccctacccatcccagcaaccctttcctccccacctccatgctctgtgctctcctcccctggtagctggagtggagctcccccgagaagaggccttgaggtggctgcatagccagttcataatggagcaagccgtgcatgccagctgtcgcacagtaaaacatcatgtctaggagggcatggagcatgggcttgctggcagcgccaacttctcctcatcctcaccgccatctatttcaggtatcctgagcatgattatcattcggac

SEQ ID NO: 330828 - DNA, 371 bp, Homo sapiens
gatcttcttcacttcttctccccaatccaaccctggcctctcttctgagcaggattggttgccgtggtctttactgcttttctccctgatgtgtgaaacaagcgccttctatgtgcctggggtcgcgcctatcaacttccaccagaacgatcccgtagaaatcaaggtaagtgtgttcctggatttttggagcctctgtgctaggcagtgtgtctggagcaccatggtgagctgttcgtgtccatcctgtggttgcagagaagaaagaatagtgccagttaccccggaactctgcctctccctctccctgtgcctctggttctcggtcccctctctgtttctggttctttctgtgtctctgtccctgtgta

SEQ ID NO: 330829 - DNA, 480 bp, Homo sapiens
tgacaagattgggagcactttgtacagtgttgttttttcccttcttttcttcacataatgtgccacatgtaatctcttcattttgacctcttcatctcttcacgttctcagtccactccttcctgttcctcccctacttcctccctggatggtgagctcctctgggatgctgaggtgccttcttcactgggagtccagatcagggctggggtcagcctcaagagattctggccaggagccctgtggtgggggcagggagtgtgcttctgctgcacaagtcgcctctccttctgtggagcccagaaggtcccctcccccttgcgcagcccccatcccgggcatcagggcctcgtgggggcctcatggtgccatgtctacaggtgccctttcccaccatggtggctctgctgtgcatgtggttcgggatctccctgcccctcgtctacttgggctactacttcggcttccgaaagcagccat

SEQ ID NO: 330830 - DNA, 4124 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggtgagtgaaggagactccgggagcgggagctggagcggggccctccggggtatcccaggatcttccagcaccccatgcctggccctgagccacctccgggacccctgactcaggcctgagggctacctctgactgggcttgtcttccccgaaatccacctccctggccctgcccctgcactcaggcttgtgaaggccccgagttttgggggaggcgccgtttcggaggaagacctcggctgctgccttcgccggttcccattctacttttggtctccgcccactgattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330831 - DNA, 3840 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330832 - DNA, 3756 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtgtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330833 - DNA, 3796 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330834 - DNA, 2125 bp, Homo sapiens
tcaagcaactgtgaaattggtaggaaggggttctgccccaggacaacactgaccttcctctgtttcctcctcaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330835 - DNA, 2238 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtccta

SEQ ID NO: 330836 - DNA, 2731 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctgcttccctttgcctacaagaggggctcggaaagatggatgtttttcttgacttctttgatatcctgaacttctctacgtagccctttatgtttcttcagtctgttcattataaatttagcttggcatttctgtttgatctcttcaactctcttcattggcatcaatagttttattccatagctctcactggatatttgataagtgcatttctatgtttttccaattcaaatgaattatccactgtaagccctttaccagctgttttccagaatgctttggtccacctacctttgtgaggattgtgcttctttttaaagtttttatgacatttagatttacaaaatctgaacaccttgcaatcattgcggacagacatcatgccatggccagggtagatgggccccgaacagaaataacactcttgagacacatgttgaacccacgtgggtccccaccgaccaaacgccaggcttgagaggaagtcaggtgtatgtttaacctaaactgccacactcttttctaaggtggtgtatcattttatgttaccatcagcagtatacaagagtgccagttcctttacatcctaataacacttggtatggttaatatttttaattttagccattcttacaggtatataacatcttgtgattttaatttctatttccctaatgacatgttgcacatcttttcatgtgcttatttgttattgttggtgacaaatgtatcttctttggtgaagtagatgttcaaatttatgttcatttgtattgggtttggagttattgtcaagttttgagagttatttatgtattctgcagacaagtcctttatcgataaatgctttgc

SEQ ID NO: 330837 - DNA, 805 bp, Homo sapiens
  misc_feature (25)..(25): n is a, c, g, or t
  misc_feature (28)..(28): n is a, c, g, or t
gcaggagcggttgaagccagacgancancttgtggagttaaactccgtaaccaggagcaccacttccgctgacgtcattacggcgacacgtggatccaagatggcgacggcgatggtgagtgaaggagactccgggagcgggagctggagcggggccctccggggtatcccaggatcttccagcaccccatgcctggccctgagccacctccgggacccctgactcaggcctgagggctacctctgactgggcttgtcttccccgaaatccacctccctggccctgcccctgcactcaggcttgtgaaggccccgagttttgggggaggcgccgtttcggaggaagacctcggctgctgccttcgccggttcccattctacttttggtctccgcccactgattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctgtaagtcgccctgtgctccttgc

SEQ ID NO: 330838 - DNA, 3195 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330839 - DNA, 3138 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330840 - DNA, 3120 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaaagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330841 - DNA, 3488 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatgaacaaatgaaaaaaaaaaaaaaaaaaaaactcgagttttttttttttttttttctcatttaacttttttaatgggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaacagtcttttactactaaacttaaatggccaattgaaacacacagttctgagac

SEQ ID NO: 330842 - DNA, 3141 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaagtgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330843 - DNA, 3143 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagtcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330844 - DNA, 3139 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330845 - DNA, 955 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattatcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330846 - DNA, 569 bp, Homo sapiens
gtgaacaaatccaccagctgaaatccatactgactctatcgcagagtgagctccaaacgccatgattgtgtcctctgcgtagaagcttcccaatgagtttctgttaatccatcatttatctataaactgttgcaagcgcttagataactagcggaattgtctgggaggagtgaagagttcatattaggggtgagaagaatgactttctcaaaaggtctgttctggaatggtttaattcctcttggactttcacaccagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggtaaagtgtctattgaccatctgacaagggtggggccgctctaattctttagcagctttggttgacagtggttacaagttgaggacatggcaggtgtggactcatgagcacagaggactaacatagcagtgtggggtc

SEQ ID NO: 330847 - DNA, 517 bp, Homo sapiens
gtctgaaaccttgcaaacagcatggcaggctagagatgctccctgcaaaagccctggcatgtccttcccatcagtaatgggtccaccgatatcgcggggattcagaacgtccattgggcagctcctcttccctgtgtgctggagaaggggcagcgccaagcactgggaaggggctagaggcagaggctctgatgtcaccgttctttctaggcgcacgtctccttcaagcccacggtagcacagcagagaatatgccctagctgccgggagactgcggtagatggggaactggtggtgctgtatgacgtgaaaagagaagagaaggctggtgaactggaggtgagtgcacaccggctctggttctactgccaagctcgtgccaaagagctgctcctttttgaacaaactcccaggcctatgggtggtttctagctgccagggcaagtgtttctagctgcagagaagggactaaaatcatattctttgaatataccgctaagcattatcttttatgtat

SEQ ID NO: 330848 - DNA, 445 bp, Homo sapiens
cctggccaagatggtgaaaacccgtctctactaaaaatacaaaaattagccgggcttggtggcgggtgcccgtaatcccagctacttgtggggctgaggtgggataattgcttgaacccaggagccggagattgcagtgagacgagatcccaccactgcactccagcctgggcaacagagtgagacatcgtctcaaaataaataaataaataaaataaaatgctttagatctacaaagcagtaggaacataatttctctctctctctctgtgaattgtagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagag

SEQ ID NO: 330849 - DNA, 731 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggtaaggcctgagtgagcaaggcttgcccttgcctctcaatgacggtttcctctcctacttccttcccacagcagcaaagcagcctctggaaaggcaca

SEQ ID NO: 330850 - DNA, 3141 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggagctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggacccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 330851 - DNA, 3068 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagaggcaagtatgattccatctgaacttgggcctgtccgtgacacacgactgcataaataaatccaggcatcagtgacatcaacattgaaaaaaaatcatcattttaaatataaggaagttgaggttcagaaaaattgttctcactccctactctgttcctggcagtgggcactgtgtgtttttggtcaccgttgggtcccaggacctagtccagtgcctggcatcagtaaacactcactgtgtatgtgctaatcagtgaacaaatccaccagctgaaatccatactgactctatcgcagagtgagctccaaacgccatgattgtgtcctctgcgtagaagcttcccaatgagtttctgttaatccatcatttatctataaactgttgcaagcgcttagataactagcggaattgtctgggaggagtgaagagttcatattaggggtgagaagaatgactttctcaaaaggtctgttctggaatggtttaattcctc

SEQ ID NO: 330852 - DNA, 2556 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggtaaaataaaaataaattatatttgcaccaattaggtcattgtcatgctttcctgtcactgcctgggatttctttctttctcagcttaatagaagttctatatatttcagtgatattagtgagaaattaaattataaatatattcttaactattttgaaccattatagttcaaaatatat

SEQ ID NO: 330853 - DNA, 2020 bp, Homo sapiens
  misc_feature (1999)..(1999): n is a, c, g, or t
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgtgcttctgtctcgactgcactttgagaaggatgcagactcatctnagcgtatcattgctcccatgc

SEQ ID NO: 330854 - DNA, 2735 bp, Homo sapiens
  misc_feature (799)..(799): n is a, c, g, or t
  misc_feature (1232)..(1232): n is a, c, g, or t
  misc_feature (1393)..(1393): n is a, c, g, or t
tttacaccaaggactaaaaaaagataggaaaaacttgttggagacccgattgcacatcactggcagagaactgaggtccaaaatagctgaaacctttggacttcaagaaaattatatcaaaattgtcataaataagaagcaactacaactagtagctgggatcacaggtgcacatcaccacaggtgcacatcaccatgcccagataatttttttgtatttgttgtagagatgaggtttcactatgttgcccatgctagtctcaaactcctgggctcaagtgatccacccaccacagcctctcaaagtgctgggattacaggtgtgagccaccgcacccagcctcccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatcaccctccaaaggtgaccaaagaggtttctttttcttttcattttcttaagtgtcattattaactcatggatttaaaacatttgatgtgtttcaaacttcagtgcttaaattggtcatgctggctggcaggcagcccatgtttttttgacctgaccctgctagtctttgcagtctctgatttctggaatccaaagatactccaggctcatcttgggcatttaatgcccagaccaggaatcagcaatttcccaaggagtcctggttcctcttcatgggaaacggtactaagagactatgntgcagacatattcaacatttgaaaagtagacttgattttttgaaaatggtcaaaagttaacaaatttagtgttaacttcttttctgttttggtgcattcccaagataatactgtatactcccagaagatgaatgcaaatatttatagttttccattggtcagtgcctttgggttctaagtgaacaagtcccaactttaacgtacacaaaaaaggaattgggaggggaggggccgggctgggaatagtgagaatgagggctggtttgtgcttctggggtctctgtctctgcctctttctggatgtcagtttcattctcttctgcaaacagtgtagggtaaacaggctttaaattaggtcctaaaagtttaggtaaatttttcattcccttccatagttgtttctaattttttattatggaaaatttcaaatagncataaaaataaaaattagtataatgagcttccatatacactcataactaagcttctgcagttataaagacatggttgatcttcatacatctgtgtgagcctccctcaatctttttatcctggacaaatccttgaaataatttttaggtctcagggaaccantgaatacaaatttggctacatcttcagttcatgatacattaacatgtccggtaagtggtaggtataataatgaaataataattaacaatgtctttctaagtagagaaagtttttttttcctgggcatctatttatcctgggcatctatttatcctggccaacttgtagcatatttttgtgtgtgtgtgatttctctcttttcataaaggaaatcagcagtaatgtaagccaaatagaatgcagatggaggaaacttcagtttttccatttccttttccatttgacttttcccccttacttctccaagtaagctagaagttttgtcacaacttcctaccatatgtcttggagtatggtatgtagtatgaccaagaatagtttctttccccaaattgtatgaaacagtgacttcctggcagtgcagaacggtgaccctgaggtagggaaacatgaggggagctcagtgtctggagaagtttcaggttacggggcagggagggcaaacccaggcagagccttgtgctccctggagttaaagagatggagctgggcttgcaggaggccaaggaggtgagaggagcaagctgccagagagagggtgtcagagagcttcagaggagcccttttgagtcttctgctcagtaatgatcagcacatgtgtgtgaggaaaccgcccagggctgggcaaggtaccacatgaaagaagcagggaataatcctccgagttcatagaaggccaggaatagtttatgttcccaccagccagagtggaggatttggtagtcacagggcgtcaaatagagtcttcagaagggtgttgcctcagcactagggcataatttggtttcacttaataaagcttaaaagctactcctgaacagtacccttaacttaccgttttcaaataagtgcatccctaacaaaactcaataatttagcaattcaaaaatatccagcatccactgaaaaattagcaggcatgcaaagaaacaagcaaatgtaacctataacaagcaaaaaaatcagtcagtagcaacagatccagaagtgacacagaagatagaattagtagacaaggacattaaaacagtgactgtaatccatctgctgaagaaggcagaggaacaactgaacatgtcagataaagacatgggagacattcaaaagacccacattagaatgtaagagatgaaaagtacaacatccaagatgaaaagtacattaggtgggatgaactgcagaatagacactatagaagagaagattagttaaatgttacataaggcaatagaaactatctgaaaaaacagagaaaaggctaaaaaaaaaaaaaaatgaacag

SEQ ID NO: 330855 - DNA, 3259 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330856 - DNA, 3412 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330857 - DNA, 3202 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330858 - DNA, 3066 bp, Homo sapiens
cggcactgtggtctccactgcctgaggaaacaagcagtaaaacggaaagtttaaaaaggaccttgtctcctacagtttcaaatagccgtctagtaagatggctttattgtgatgtttaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330859 - DNA, 2558 bp, Homo sapiens
cagcacgacgagccaggtgtgctggctgacgttgtggatggtcaggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330860 - DNA, 2070 bp, Homo sapiens
gcgagtttcactctggctgccttctcctgagagtcggagccacagccagagccctgcccaggccgagccggagctgcagcccgagcgtggtggtgccctcagccccgtcctcttgtcctcctcagcctcgattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330861 - DNA, 2275 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaaggtagcagctccctcggggcctctggccttgtccctgagcagtgggtcctgcccagagctccctccatggctctccagcatcctcccgggctcactcctatgggctgccccgtcatccggatctgaagggcaggtttctcctgggctccagcccagacacaggctgcgtgaggccacgtgaggccccatgctcagtgcttggcccaggcctggctccaaaacgtggtgcctgtccacaccagcacagtccacaggccaggactttgtgtagggtttctgtgtgcagcagagtttagtgaaacaggcagtttccacggcagaaaaaagagaatgggaattcaacttgtagtataattgtttggcattaaaattttaaatgtaagtatctagttttatttatttagtccatcgtacatgttggcaaagggagagcttttcaaagaacccctcaggagtgacagcaggttgggatccagacagcagtgactttacctgggccacttccttccctgtgttggagaagcatatcgaatcctcagtagggcaggtgctgcgctgcgtctcagcagcttggcatggaaccaccctctgccctcttggccccgcaggtcagtgagagacaaactcagagcacacgtggtgaggggtcccgagggggtgcacaggaggcagggggctggctgtgtggaggcagcagtccagacagatgctggggcagcgcggcgggcaggaagcggagtggtaggagctggcttaggttgtgcacgtgctgggggcggggctggggggacagagatggggttg

SEQ ID NO: 330862 - DNA, 3830 bp, Homo sapiens
  misc_feature (2023)..(2023): n is a, c, g, or t
  misc_feature (2456)..(2456): n is a, c, g, or t
  misc_feature (2617)..(2617): n is a, c, g, or t
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcacccaggctggaatgcagtggcatgatctcagctcactgcaacttccatctcctgggctcaagtgatcctcccacctcagcctcctaagtagctgggatcacaggtgcacatcaccacaggtgcacatcaccatgcccagataatttttttgtatttgttgtagagatgaggtttcactatgttgcccatgctagtctcaaactcctgggctcaagtgatccacccaccacagcctctcaaagtgctgggattacaggtgtgagccaccgcacccagcctcccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatcaccctccaaaggtgaccaaagaggtttctttttcttttcattttcttaagtgtcattattaactcatggatttaaaacatttgatgtgtttcaaacttcagtgcttaaattggtcatgctggctggcaggcagcccatgtttttttgacctgaccctgctagtctttgcagtctctgatttctggaatccaaagatactccaggctcatcttgggcatttaatgcccagaccaggaatcagcaatttcccaaggagtcctggttcctcttcatgggaaacggtactaagagactatgntgcagacatattcaacatttgaaaagtagacttgattttttgaaaatggtcaaaagttaacaaatttagtgttaacttcttttctgttttggtgcattcccaagataatactgtatactcccagaagatgaatgcaaatatttatagttttccattggtcagtgcctttgggttctaagtgaacaagtcccaactttaacgtacacaaaaaaggaattgggaggggaggggccgggctgggaatagtgagaatgagggctggtttgtgcttctggggtctctgtctctgcctctttctggatgtcagtttcattctcttctgcaaacagtgtagggtaaacaggctttaaattaggtcctaaaagtttaggtaaatttttcattcccttccatagttgtttctaattttttattatggaaaatttcaaatagncataaaaataaaaattagtataatgagcttccatatacactcataactaagcttctgcagttataaagacatggttgatcttcatacatctgtgtgagcctccctcaatctttttatcctggacaaatccttgaaataatttttaggtctcagggaaccantgaatacaaatttggctacatcttcagttcatgatacattaacatgtccggtaagtggtaggtataataatgaaataataattaacaatgtctttctaagtagagaaagtttttttttcctgggcatctatttatcctgggcatctatttatcctggccaacttgtagcatatttttgtgtgtgtgtgatttctctcttttcataaaggaaatcagcagtaatgtaagccaaatagaatgcagatggaggaaacttcagtttttccatttccttttccatttgacttttcccccttacttctccaagtaagctagaagttttgtcacaacttcctaccatatgtcttggagtatggtatgtagtatgaccaagaatagtttctttccccaaattgtatgaaacagtgacttcctggcagtgcagaacggtgaccctgaggtagggaaacatgaggggagctcagtgtctggagaagtttcaggttacggggcagggagggcaaacccaggcagagccttgtgctccctggagttaaagagatggagctgggcttgcaggaggccaaggaggtgagaggagcaagctgccagagagagggtgtcagagagcttcagaggagcccttttgagtcttctgctcagtaatgatcagcacatattgattttatttttaactgacatgaggccatttctgcccacgctcttgatgcttagtaaaacatgaacgagcctgttaaagcaacatgcaggagatggagaagttcggccacatgcccattgctttcctgcgagtggcaggagagtcttctgtcactgggaccagaatgtgcctagaggcaggaaatctcaacacgactgtgagatcagaccacaatccacaaagcgctgctgtttctctcaaaggcaggttctcaggctgagccgtagatttggagaaagcacccctcacccagctccacatctgtgtgtctgcgtgcacacgtgtgtaaaacatggtgtatgtgttctcaaacattcacgaaattagaaatgttgagagagatgaaaataaatataaaaatactgctgtgatacatttttcttgccgcacccacaactggactgtgtacatgggccctctttaggagacttaaactcaatgctgaaacactttgcacaatgcctggcgtgttatgcactcaataaacattagtgtctatcgttaaaaaaaaaa

SEQ ID NO: 330863 - DNA, 1502 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggtacccactttcacatgccctagctctcttgggtatgaaagaacaaaaaaagataatcccacaggagtgttaataaccaggaactctttattactccagattgggaaggaaggagaaacttgtccttttttttttcttgagacagagtctcactttgtcatccaggctggagtgcag

SEQ ID NO: 330864 - DNA, 3776 bp, Homo sapiens
  misc_feature (1969)..(1969): n is a, c, g, or t
  misc_feature (2402)..(2402): n is a, c, g, or t
  misc_feature (2563)..(2563): n is a, c, g, or t
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcacccaggctggaatgcagtggcatgatctcagctcactgcaacttccatctcctgggctcaagtgatcctcccacctcagcctcctaagtagctgggatcacaggtgcacatcaccacaggtgcacatcaccatgcccagataatttttttgtatttgttgtagagatgaggtttcactatgttgcccatgctagtctcaaactcctgggctcaagtgatccacccaccacagcctctcaaagtgctgggattacaggtgtgagccaccgcacccagcctcccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatcaccctccaaaggtgaccaaagaggtttctttttcttttcattttcttaagtgtcattattaactcatggatttaaaacatttgatgtgtttcaaacttcagtgcttaaattggtcatgctggctggcaggcagcccatgtttttttgacctgaccctgctagtctttgcagtctctgatttctggaatccaaagatactccaggctcatcttgggcatttaatgcccagaccaggaatcagcaatttcccaaggagtcctggttcctcttcatgggaaacggtactaagagactatgntgcagacatattcaacatttgaaaagtagacttgattttttgaaaatggtcaaaagttaacaaatttagtgttaacttcttttctgttttggtgcattcccaagataatactgtatactcccagaagatgaatgcaaatatttatagttttccattggtcagtgcctttgggttctaagtgaacaagtcccaactttaacgtacacaaaaaaggaattgggaggggaggggccgggctgggaatagtgagaatgagggctggtttgtgcttctggggtctctgtctctgcctctttctggatgtcagtttcattctcttctgcaaacagtgtagggtaaacaggctttaaattaggtcctaaaagtttaggtaaatttttcattcccttccatagttgtttctaattttttattatggaaaatttcaaatagncataaaaataaaaattagtataatgagcttccatatacactcataactaagcttctgcagttataaagacatggttgatcttcatacatctgtgtgagcctccctcaatctttttatcctggacaaatccttgaaataatttttaggtctcagggaaccantgaatacaaatttggctacatcttcagttcatgatacattaacatgtccggtaagtggtaggtataataatgaaataataattaacaatgtctttctaagtagagaaagtttttttttcctgggcatctatttatcctgggcatctatttatcctggccaacttgtagcatatttttgtgtgtgtgtgatttctctcttttcataaaggaaatcagcagtaatgtaagccaaatagaatgcagatggaggaaacttcagtttttccatttccttttccatttgacttttcccccttacttctccaagtaagctagaagttttgtcacaacttcctaccatatgtcttggagtatggtatgtagtatgaccaagaatagtttctttccccaaattgtatgaaacagtgacttcctggcagtgcagaacggtgaccctgaggtagggaaacatgaggggagctcagtgtctggagaagtttcaggttacggggcagggagggcaaacccaggcagagccttgtgctccctggagttaaagagatggagctgggcttgcaggaggccaaggaggtgagaggagcaagctgccagagagagggtgtcagagagcttcagaggagcccttttgagtcttctgctcagtaatgatcagcacatattgattttatttttaactgacatgaggccatttctgcccacgctcttgatgcttagtaaaacatgaacgagcctgttaaagcaacatgcaggagatggagaagttcggccacatgcccattgctttcctgcgagtggcaggagagtcttctgtcactgggaccagaatgtgcctagaggcaggaaatctcaacacgactgtgagatcagaccacaatccacaaagcgctgctgtttctctcaaaggcaggttctcaggctgagccgtagatttggagaaagcacccctcacccagctccacatctgtgtgtctgcgtgcacacgtgtgtaaaacatggtgtatgtgttctcaaacattcacgaaattagaaatgttgagagagatgaaaataaatataaaaatactgctgtgatacatttttcttgccgcacccacaactggactgtgtacatgggccctctttaggagacttaaactcaatgctgaaacactttgcacaatgcctggcgtgttatgcactcaataaacattagtgtctatcgttaaaaaaaaaa

SEQ ID NO: 330865 - DNA, 229 bp, Homo sapiens
ccattagaaggatgagattataaacacagctcccttcctaaacattaggatctctcttttagagcagtcagcctttgaatatataccaagaacggggaaagaattccagtcattcacaaaaaggtttcaaatgctaaaaatgtttcaaatgctgcttggcagtgatgtcactgtccttctctttccagtgagtgttgcagagagctgctggacacagtggataactatg

SEQ ID NO: 330866 - DNA, 3370 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330867 - DNA, 3140 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtggtataagtggtataggtggtataggtgactatagggatcctctaggtcgc

SEQ ID NO: 330868 - DNA, 3408 bp, Homo sapiens
acacggcggccgagtgtcctcgaccccagcctcagcagcactgcttggcgccccggttcccggtccgactgggcacctctcctggccaggggtggagcggccgcggggcggggggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330869 - DNA, 2954 bp, Homo sapiens
atatgcggacagctcggcgcttcacgacgatgatatctgggcattgacctagagactgcgaagcaaatacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330870 - DNA, 3334 bp, Homo sapiens
ggcctggtgcagctgaaggggaagcaaagggagctggcgctgtgggcactccagggccacaccaggaggttctcctgtgatagagacaggccatgagtctacagatgtcttcatccctggagatgtttccagcagccactctgttctgcctgctcctactgtggggcctgtggagtctggttccacaatgatgatgcttttgttttcctaagagatgaggccgctttcctgctgtggggaaaatgcagggaggcgcctgttgcctgggctgggcaggaggcaggatcaggtctctggaaggaaggagtctgttttctcccccgtcctcgctgctgctgatggtggggctggtctccctgggagaatgtagcaagtcacttaactttgttgaaagctttctgtctccttgttgggaaaataatgaggttggattaaattcctggttttcaaacttgctttgttgttgttgtttttaagcagcaaaatcccctttttaaatgacatttttatggggatactagtttacaaaataaattgggaactctcctgattggccctgggtgggagaggtgaagagactagaaccctctgcagccgtcctgcgctcctgcagcaatagcaggcaactctgagaaacagggttgagaaccaagaggttagatgacctttgtctctgggcactctgtgggttccgaatggaatgacaggcctcagaaggccctggagtccttgctccccaggctgtggggggcgggtcaccagctttggcattgcccaggagcccctgattccacatcacattttaacttgaatccctgggcgattcatcgaaggctggaaggccttcccaccgcgtgcagaagctctcctacccggttcctacctggttcctagaagagaatccatgcacctcacacccgcgacctctgcagtgggagtgctgggttggcgagcagcccatcctgatgccggatggtggatggcggggctggcgaggcacctccttcctgccccacgggcatctcacttccactgcctgcctcagaagcagcacttccaccacccctctgcctctgtggcacctctgccatttggctgggtgaggagaggtagaaagagggccccctgtgctttgctttggttttttggctttgcctggaaatgcggagaatcctgcagagcgcagactgagaggctgtgaaatctcagtccctaacttgggatgggactttgctgttttcctaaaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330871 - DNA, 1379 bp, Homo sapiens
cagagtccaaacagtgctcagagtccaaacagtgctcagagtccaaacagtgcccatgcatggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgactgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccgcagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaattgtcaccctaattttgcattaatttactcagcctccccagctgtaggtgttgaaagtgtctgggtgactagctcttcattttgattgcaggatgtctgtttccactgagttttgtgaggagatgatggaaggatgatctcagaagcagagggcatctgctgtgaaagatgccgcacgccaagcggggctggggtgcatcctgggcaggggactgaaatgtacctgtcagggtttgcctcagaagtgcctggtgagctgaggt

SEQ ID NO: 330872 - DNA, 3959 bp, Homo sapiens
  misc_feature (2023)..(2023): n is a, c, g, or t
  misc_feature (2456)..(2456): n is a, c, g, or t
  misc_feature (2617)..(2617): n is a, c, g, or t
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcacccaggctggaatgcagtggcatgatctcagctcactgcaacttccatctcctgggctcaagtgatcctcccacctcagcctcctaagtagctgggatcacaggtgcacatcaccacaggtgcacatcaccatgcccagataatttttttgtatttgttgtagagatgaggtttcactatgttgcccatgctagtctcaaactcctgggctcaagtgatccacccaccacagcctctcaaagtgctgggattacaggtgtgagccaccgcacccagcctcccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatcaccctccaaaggtgaccaaagaggtttctttttcttttcattttcttaagtgtcattattaactcatggatttaaaacatttgatgtgtttcaaacttcagtgcttaaattggtcatgctggctggcaggcagcccatgtttttttgacctgaccctgctagtctttgcagtctctgatttctggaatccaaagatactccaggctcatcttgggcatttaatgcccagaccaggaatcagcaatttcccaaggagtcctggttcctcttcatgggaaacggtactaagagactatgntgcagacatattcaacatttgaaaagtagacttgattttttgaaaatggtcaaaagttaacaaatttagtgttaacttcttttctgttttggtgcattcccaagataatactgtatactcccagaagatgaatgcaaatatttatagttttccattggtcagtgcctttgggttctaagtgaacaagtcccaactttaacgtacacaaaaaaggaattgggaggggaggggccgggctgggaatagtgagaatgagggctggtttgtgcttctggggtctctgtctctgcctctttctggatgtcagtttcattctcttctgcaaacagtgtagggtaaacaggctttaaattaggtcctaaaagtttaggtaaatttttcattcccttccatagttgtttctaattttttattatggaaaatttcaaatagncataaaaataaaaattagtataatgagcttccatatacactcataactaagcttctgcagttataaagacatggttgatcttcatacatctgtgtgagcctccctcaatctttttatcctggacaaatccttgaaataatttttaggtctcagggaaccantgaatacaaatttggctacatcttcagttcatgatacattaacatgtccggtaagtggtaggtataataatgaaataataattaacaatgtctttctaagtagagaaagtttttttttcctgggcatctatttatcctgggcatctatttatcctggccaacttgtagcatatttttgtgtgtgtgtgatttctctcttttcataaaggaaatcagcagtaatgtaagccaaatagaatgcagatggaggaaacttcagtttttccatttccttttccatttgacttttcccccttacttctccaagtaagctagaagttttgtcacaacttcctaccatatgtcttggagtatggtatgtagtatgaccaagaatagtttctttccccaaattgtatgaaacagtgacttcctggcagtgcagaacggtgaccctgaggtagggaaacatgaggggagctcagtgtctggagaagtttcaggttacggggcagggagggcaaacccaggcagagccttgtgctccctggagttaaagagatggagctgggcttgcaggaggccaaggaggtgagaggagcaagctgccagagagagggtgtcagagagcttcagaggagcccttttgagtcttctgctcagtaatgatcagcacatgtgtgtgaggaaaccgcccagggctgggcaaggtaccacatgaaagaagcagggaataatcctccgagttcatagaaggccaggaatagtttatgttcccaccagccagagtggaggatttggtagtcacagggcgtcaaatagagtcttcagaagggtgttgcctcagcactagggcataatttggtttcacttaataaagcttaaaagctactcctgaacagtacccttaacttaccgttttcaaataagtgcatccctaacaaaactcaataatttagcaattcaaaaatatccagcatccactgaaaaattagcaggcatgcaaagaaacaagcaaatgtaacctataacaagcaaaaaaatcagtcagtagcaacagatccagaagtgacacagaagatagaattagtagacaaggacattaaaacagtgactgtaatccatctgctgaagaaggcagaggaacaactgaacatgtcagataaagacatgggagacattcaaaagacccacattagaatgtaagagatgaaaagtacaacatccaagatgaaaagtacattaggtgggatgaactgcagaatagacactatagaagagaagattagttaaatgttacataaggcaatagaaactatctgaaaaaacagagaaaaggctaaaaaaaaaaaaaaatgaacag

SEQ ID NO: 330873 - DNA, 1288 bp, Homo sapiens
  misc_feature (1266)..(1266): n is a, c, g, or t
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactatgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcctcgacatgtncggggtcctctagagcgccgca

SEQ ID NO: 330874 - DNA, 723 bp, Homo sapiens
  misc_feature (679)..(680): n is a, c, g, or t
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagnngagacagtgggtgagttgtccagtggtgcagatgtcggacgcc

SEQ ID NO: 330875 - DNA, 4015 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatc

SEQ ID NO: 330876 - DNA, 836 bp, Homo sapiens
gccctctccctctccctagtactgctgcgcacggccactgccaacggcttccagatggtcaccagcggggtacagagcaaggccgtgagtgactggctgattgccagcgtggaggggcggtgacggggctgggcggagaggcaaatatgaagtgtcctcaaattgtaattgctttttatgaagagagactaacttggcattcttgtccagaagatgaagctcaataattgttcacattgttcttttatatatatttatatatatatataaaaattgggtcttagatttgatttactagtgtgacaaaataactacatcctaatgaaaatcaagttgatatgttgtttgaaagtagcgtggaagagtgtgggggtttttgatccatagcactggttactttgaacaaataaataaaagctttctgtagttgttcctttatcagaaaagaacatttgataccatggtatatcatttcctcttcattaaagaacagttttctaaatgtgggggaaatgtccatagtcattactcagtcaaaaactgtgtgttctcatgagcctaaggaacattctagattattacgggttcgtgtgtgtgtgcgtgtggtgtgtgtggtatccatacaatggatattggtaactttttttggttttaagcattcaccaaaaagaaaattcacggtaaacccatgtttctgagttgcttttcaaggaaatagaagataatccttagttaatggaaatttctgaacctcattcggaaaagtttgaaaggcacaggggaaacggcgtaggggggtttggcagccaaagaaaattgggcgcaggggtccagga

SEQ ID NO: 330877 - DNA, 3732 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggaacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatc

SEQ ID NO: 330878 - DNA, 4036 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccaggtgagcagtgcccaggctcagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatc

SEQ ID NO: 330879 - DNA, 2532 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgaccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatc

SEQ ID NO: 330880 - DNA, 2285 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtcgtcatgatggatgcactgactgaccgtctggggctcaggctggtgtgggatgcagccggccgatgagaaaataaagccatattgaatgatc

SEQ ID NO: 330881 - DNA, 2384 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatc

SEQ ID NO: 330882 - DNA, 4061 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatcgccaccagtgtttggtctgggggctgtgagaattggattgtgaaaa

SEQ ID NO: 330883 - DNA, 3738 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttccttctgaatttattctaagagcatctttctttttgcttttttgttgatgctgcttgactttctatc

SEQ ID NO: 330884 - DNA, 2475 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccggga

SEQ ID NO: 330885 - DNA, 2399 bp, Homo sapiens
  misc_feature (1)..(2): n is a, c, g, or t
  misc_feature (5)..(5): n is a, c, g, or t
  misc_feature (7)..(8): n is a, c, g, or t
nncangnngcaaggtcacgtcctgtccccacctttcgcccctcaccccagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacagactacaattcccgacaggcagcgcggctggcggggcggttcgcggcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgcctctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagaagcttgggagacgtcccggggccaggctacggacttgcggacgagccccccagtcctgggagccggccgccctcggtctggtgtaagcacacatgcacgattaaagaggagacgccggga

SEQ ID NO: 330886 - DNA, 487 bp, Homo sapiens
agggggaggcaacataaaccttcaaattaataagtaaataattttgtgtagtgataaatattgtgaggaaaaaaagacgaatgatatagagagagtctgtttcgggggtgagggtagggatagcactgcttttcccaggatggtcctggaagacattcctgaggagatggcatttgatctgggacgtgaatgatggcaaagaagcagttgtgtaaagatctagaagaaaagatatcttaagtagaagcaacagcaagtgcagaggccatgaggcgcggctaaactgatgggtttgagaggctgaatgaaagtaggccgtgtatggctggatccagatcataaaggaccttgtggaccttggcacaggagtatatttttgttctgatagaatgagaagcatttggggggctttaacaaaggcatgacaggatttcaggcacgcttttgaaaactgaagacttgttaacgtggagaatggagtgtgggg

SEQ ID NO: 330887 - DNA, 936 bp, Homo sapiens
agtagaaaagagagagaacgcaacaacaaaagagaaaaaaaaaaaactccttgaggggaacatggacagtgtgtgaattataagagctctgtttctaaagtgattcaactatacttgcacagaattccaaaagctctactgtttattactcttcattactaatacagcctttgattgtaagcaggctgtcctttgtgaataacaatcacagatacagacatcttcagacagttcaagtcgtgtgcttcaatcaaactctagtcggaaaagaactttcagagcaaggctgcttccacagtactgacaaaatctgctatatatcacataacattgcatggtgcactcactcaaactttatgtttccctgttttataaattcttaagagcactgcatggctcacaaaaatctaatactggcactctctatgttggcgattactgaatggaaatatgcatatttagcttgaaagaaagaagggtaatattttccttgcaatttattcaccatttcctttatataacctgaaatcatgagctttgtgacacattggaaaagaaatactttattatagaaaatataactagatagtaatgagttttaaagcagagtattgaccatgtataatggttctcacagatatgaaatgaaaaaatccgaaaaataaaagtaaatctcttaaaaatactaaatgttattgaacctgtttttactgcatggatatttttgtgattctagaaattacctaattaaattttatatttatagaatgaaaaatcatgtaagaaattatgtaaaggtgattcaatacaatatgacatttaatcaaggcagtttagtaaatagtaagaggactaagagtgctaaatgactatgcatatatgtgtgttgcataaaataaaaggaaaatgagaataataatccacacaagttatcaa

SEQ ID NO: 330888 - DNA, 518 bp, Homo sapiens
  misc_feature (16)..(16): n is a, c, g, or t
  misc_feature (38)..(38): n is a, c, g, or t
  misc_feature (518)..(518): n is a, c, g, or t
atctttaaaaatagtnaccacagctagttatttaaaantttgccaggaaaagaggaaccagaagcagcagctgactgtctttgttgactgtgtgatccagagcagacccagtggatttgggagctccctttccctccccaccactgcctccagtggttttattctctttttacctacccccagtactagatcccttcagtcgctctttcacccctgaacttccaccaccaccatgtcccccaaagccattccctggaccagcaataatttatttagtctctgcccctctctcgggcttttagcaagaaatgcccaagaaaacttcagttttagcattttctttacagtcttctatattcttgatcacttgtcgttgcttttgtctttatgtctaggtgcaaagtaagaaaagaaaagcagatacaggccaggcgtggtggctcttgcctataatcccaggactttaagaagccaaggcaggaagattgcttgaacccaagatcccgcctctaaaaaan

SEQ ID NO: 330889 - DNA, 280 bp, Homo sapiens
gctggtctcgatcttctgacctcatgatccacccgcctcggcctcccaaagtgctgggattacaggtgtgagccaccgcacccagccctctgggagactttttagagcttggctgtgagtggagggagagaattagcaactaggaactggaaattagcactgggttgaggggcagctactgcctgtttgtggggttactttgcctctgggaagactcgagcacatccacctgctgagaagaggggccgagaggggaaagacccaggagaagggcaggagg

SEQ ID NO: 330890 - DNA, 579 bp, Homo sapiens
ccaggccttgtgctgctgctatggtggtcagttgattgctaacttcaccatcctcagccaacagtgaccgagcagctgctgtcctcagccctgtgctggggatgagacagggattctgagttaaatcggacatgcttcttgttcccagcacagtctagtcccgtgcaacaggcaactgcactgtgcactgtggcagcaggtgcttcctgagcactgactctgtgcctgacatggcacctagcacccccgctgtgttagccctcagatcctcaccatagcctaggctcaggacagtgaagtagcttccccaaagccacccttctgatgccagagccaggactggagcccaagttcgaaggcctcagacatctgagcccttaactgaagagttacctgcataggactgtggaagcatggcagaagtccctacccagagagggactctgggaagtcttcctaggagtggggatatctggggccttgagggatgcatggaggtttgggaatcagaagaaggaggggaatgtagctggcctctgcacagcctgcttctgggcctgttctgaggtcacagtgttt

SEQ ID NO: 330891 - DNA, 595 bp, Homo sapiens
ctcagcttcccaaaatgctgggattacaggcataagtcaccgcgcctggcaaattcaaccaatttagtgttactacacatttaggctctttccaatacagatatctttttgaagctaagagtttaaaaatttataattttatgaaatgtttaatatggccatgtttagaggtttttttgaagtgttattttaaaatagtagattaataagacatttatatgttctatttgccctttttattttgagagattatacctttgtcataaaattactttcaccaattatagttaaactgtatggtagattattaattacaaacttacctatgaaagatttttggaactgtacactattaatgaaacgtaactatggtttcagttggtaacatactcatgcataattgattatatattttatctcataaggttttgagtcagaactatttttattatacatgaaatgaaataatgacacccaccctcatctttgtacaagattaaaaggaacaacagtgaactgtcttatttggaaaatgacatggcattattttagaaaacatttagaaatttattatactaataagccctaatatgga

SEQ ID NO: 330892 - DNA, 179 bp, Homo sapiens
catttctagcagcagaattctttaatttgaaaaagttgttgaattgtaatggacccagttctaacctaagtttcaggtcagtgactttgtataattcattggctctctgtgtctcagttttccttatctgaaaagggggataattattgctgctccccagtgcacagatacattatttt

SEQ ID NO: 330893 - DNA, 944 bp, Homo sapiens
gtttctgtttttcttctttttaaaatagtaacaacttaggattttgtgtgccaccagcttccattccatttcataaaagcttaatctagcaagaattggtgagccctagtagaagttagaaagaaatgttgaagtgtgtatgtgtgtgtgtgtgtgtgtgtgtgtgtgttggcatcagaatcaccttggacactttttaaaacaatgcccttggctgggcgcggtggctcacgcctgtaatcccagcactttgggaggccgaggcgggcggatcacgaggtcaggagatcgagaccatcctggctaatgcgatgaaaccccgtctctactaaaaatacaaaaaaattagccaggcttggtagtgggctcctgtagtcccagctactggggaggctgaggtagaattgcatgaacccgggatgcggagcttgcagtgagctgagatcgtgccactgcactgcagcctgggcgacagagcaagattccatctcaaaaaaaaaaaaaaaaaagaaaaaaaaacaccatgccctcaccctaaggttctcctctgtctgctcttaaagaacagaaaatagaaaacattcctgacattgagaattactggtccatagtattaatattttgttttaaaatttgtgaacatatttaacttttaaaatgttttatatccaacagtctgtttggggggaagaaatcctctggtaacagttcacatgtatactcacgatatttgtcagtgagacatgtagatctcattgtaggaaatcattccactcattgagaaggggcttactgttctcattttctatagtaacttgtttttgttctgtttatatgttttacagacatttaatgttattaaatgactttctcatttaagtctcaaaacacaaaaagtgttttttagattttttttttcacagttgttatgatcatcatcattg

SEQ ID NO: 330894 - DNA, 542 bp, Homo sapiens
cccctctgtttattgcttcctaacatccccaaagtctgaagtaaggtgttctccatgtatttggacttcttccatggacccaattatcacacgaaaattgtagtctccaagccaggactggctatgtaatttgtggggccacaagaaaaatcaaaatgcgaggctccttatgaaaaaattagtaagtatttcaagatggcaatggcagagcattcaaccaagcacgaactcttctgagagcgggtccctgtgcaactgcatgggttgcacatccgtgaagtgagccctgcctggccctctaggaacaaactctcattctgctcctgtactgttacctgcaagacagaccctttagttccactttccaccacctgagaatggatactgagttaaccatctgccaaacgggcaggcattcccaacatctccactaagactgcattcttctctttcttcccatttctgttactaccactctgcatcaacccttacgatctaatcccttcaacagtctttggtctggcttgtttccaacagctcat

SEQ ID NO: 330895 - DNA, 308 bp, Homo sapiens
ccaagggagaaggcagaaagacaaaaaagagacaaaggggagccaaactcattattttataaggaacctactaccaggataacaaaactcactgcattaatccattaattaagggcagggccctcacagcctaatcacttcttaaagttcccactatttttttttttttaaccattttcttcaatagccctgacagtcccacctcttaatactattacaatggcaattaagtttcaaagtgagacattcccaccatagcagggagttaatatccagaatatatgtataaagaattttacaactcaaca

SEQ ID NO: 330896 - DNA, 345 bp, Homo sapiens
ggcccagtaaaagtcatgcccttcatccccagtcccttatgtagcattagttcatggcaaagctggggccagggcccctgatcttttcactccactgtctagagtgccttcaagtcttgtcaaggagatcaggagatccccaaactctccacatggaaattagaatgaattccatgtcaggtaaaccacaagcagcaagggcacacaggaaggtggcacctttgaggttttctggcttgaatgcaagttgtttttgagatagggtcttgctctgtcacccaggctggagtgcggtgatgcaatcatggctcactgcagcttctacctcctgggctcaagtgatcc

SEQ ID NO: 330897 - DNA, 3036 bp, Homo sapiens
cgtcctcccagcggctgggttcccagagtgctccgcggccgtgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtccctgcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcagcgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaac

SEQ ID NO: 330898 - DNA, 624 bp, Homo sapiens
cgtcctcccagcggctgggttcccagagtgctccgcggccgtgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggtaaaaaaaaaaaaaaaaaaaaaaaaaaaaaacgtggttgggccgcctgtgggcccctggaaaaagtttttaaaaccatttccgttgggggcggcggcgggcccccagttgaggtctagtggtgcacaccggttggtccccaagacgcgtggtgcccctaagagggaaaaatcccggggcggccaaggacatcacgggggcgccggagatttcctctcccccccaattaaaaagacgcgccgcggggggggaccaccccgacgaggcgtttctcgacaaccaaatccccccagataggggagactcccgggaggcacccatacgcgggggatgtctccatataccacagcggggattcccgaggcggaagcgcccgaaaattcctaatttaaccccgcctctgaagta

SEQ ID NO: 330899 - DNA, 3694 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330900 - DNA, 3444 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaac

SEQ ID NO: 330901 - DNA, 3876 bp, Homo sapiens
  misc_feature (3777)..(3777): n is a, c, g, or t
  misc_feature (3840)..(3840): n is a, c, g, or t
  misc_feature (3872)..(3872): n is a, c, g, or t
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaactcgtgccgaattcggcacgagctcacattagctgattactcagtgatatcgttgtagcacagataataaacaaattcactctgtttcacagtattaataaagaaaaactttaggaaggcataattgttcttgacctcagtcttaaaaccatagggaataaatactccagaatacagcagtttcccttaggatgcatgttttagagtctgtcattcttttatttattttttaagttagtcttcatgtgtcagctgttcctctagccttctctgggtcctaagtaaatgtgccttcagagttttctgctcatacctaataaaagtcaagaatgtncccacatgctacgtatgcatgtcaatacagactgatttctgagttccttctggaagtgctcangagggaaagtcaggcagtgtgaactgagattnaggc

SEQ ID NO: 330902 - DNA, 4250 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgaggtgggttggggcgggctctggggatttggtctcacagcccggatcccagcccacttaccttggttactctccttccttctagggtcctctctgcccagttggaccaggcccaggtggcccaggccctgctggcccaatggggcccttcaatcctgggcccttcaaccaggggccacccggggctcccccacagtgagtatcctctgcctcctgggttttgaggccgggggcttactgagctggcaagaagaatagcagaccccatttccctttccctagaagtgcaggcggggggcctcatccagcccatttttgtggataccatcaacaggccctctcctgtctactggtagagcatgtgcctttcagcatccctctgtgcacgtgcaagtttcgcggcttctttcatgtcctcaagctgacgctgcgcgtccttcgagttgcttcttgtctaggcctttcccaggcgccccgttgagcctggtggtctgggtctctggcgcctccccactgaaaaacatccccaccccaggtggtccggctgcggccacccccgcaccactgctcaagcatccctttcttctctcctgcagtgccggggggccccctcctcaccagtacccaccccagggctggggcaatacctacccccagtggcagccgcctgctcctcatgacccaagtaagtgatgggccacctggcggagggcaggccctgttctgtccccccgtctcacccgaggtatctcctgcaggcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330903 - DNA, 3145 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaagga

SEQ ID NO: 330904 - DNA, 3115 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctagacccctcctcccccaccctgcatttagtttctcctttggataaaaccagtaaaaaatagaatgtttgggatctta

SEQ ID NO: 330905 - DNA, 3656 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330906 - DNA, 3447 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggatttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330907 - DNA, 3205 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaaccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330908 - DNA, 3431 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgtactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330909 - DNA, 3321 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330910 - DNA, 2961 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaagga

SEQ ID NO: 330911 - DNA, 1612 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcgtctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaagga

SEQ ID NO: 330912 - DNA, 971 bp, Homo sapiens
gggcggtaggcgggggcctggccctcccgctgcgcctcgagtgggatcccaacgggtgacccccctgcagggagtaggggcgcactgggggtcaccaggagcggcgcctgggtgtgcaggcgccccggagctcggagacgcacttttgggaccccccccttagccccccggccttaggacatgcctggaggcaggggtccaccttcccgggcggagggcctttactctcccctccatatcagggcaaagggcagtgtttgcccccaacccagtcccatttctgtcccctctctaggagaaagggacattgtgggggtgggagggacagtccttcctcttcagtcgggaaagtggatggggacctgtctagggctgagcacttgggcgaaatggggaagacgagcatggggactggctcttggatgctttggtggcttgaaagcgtggtctgtctctttgggggaaacgaagggagggtctcccacccccgtgtattgaggcgtaatgacaaggaagtgtcacatgctgctaggactgacctctccagctccatttgcagcctccccatggcctggaggggtgggggtcggtagaatgggaggactttgccgccgaccggctcctgggctgtcccaatgcctccggggctagagactggctcctcccaaggtgggaggtcccgttaagtgaacgcctgtgttctggccctctgtcgtctctctcacccttggagttgggtgggttctagcgtgcatttggtcttattgcccatggaaccgtctgattctgggacagcttgaagggaggaagctggtgctgtcagttggtggggacaggccccctgtgggcatcccatgagttttggctctagggcagcgtagaaaaatggagactggtggaaagggagattcttaacatggtttgggtttctaaaccccagactctgatcctaagtttgctgggttgaggtt

SEQ ID NO: 330913 - DNA, 3116 bp, Homo sapiens
ggactgtatcaagcttagtatagggcgacgtggagggttttaaccgcgggtgcgcgtactgatcaacttacagttgatcagcaatcgcgactccgatcgtcagacggatatcacgaactctcagagctcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330914 - DNA, 3671 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330915 - DNA, 2846 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330916 - DNA, 3669 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctcttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330917 - DNA, 3614 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330918 - DNA, 3510 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330919 - DNA, 2679 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcagcgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330920 - DNA, 2562 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggctcccagccagactacagtgccgcctgggcggaatattacagacagcaggccgcttactacggacagaccccaggtcctggcggcccccagccgccgcccacgcagcagggacagcagcagcgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccctttttttttttgttaaataaagtgctttttgtttaaaaaagac

SEQ ID NO: 330921 - DNA, 2973 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatcgctggctcaacatggaaggatccca

SEQ ID NO: 330922 - DNA, 2626 bp, Homo sapiens
  misc_feature (2591)..(2591): n is a, c, g, or t
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgtnagagagagcgtcgggatcctctaagtcacctcaga

SEQ ID NO: 330923 - DNA, 1634 bp, Homo sapiens
aaaatacggctaggtacgaggcctgggtgaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcgcccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaac

SEQ ID NO: 330924 - DNA, 172 bp, Homo sapiens
cgttctttcttgcaaggggcatagatgtctgtctcccttaggagggaggactgctaaggcagggaggaggctattgcctcctggtgggagagggaggttcccagccactggtctgcagattcatcttaaacaagtcttgcccatggcattcaacttcctgctctaaccccca

SEQ ID NO: 330925 - DNA, 1052 bp, Homo sapiens
ccgcccgagttgccgcccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330926 - DNA, 2060 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgcctccccgtccctgtctcccctgacacccgttcctccagaagcccggtaaaccccgcccttacaagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330927 - DNA, 2267 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggatgggctcccacctgcatgcctgtccccgcaggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330928 - DNA, 2056 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330929 - DNA, 2001 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgcctccccgtccctgtctcccctgacacccgttcctccagaagcccggtaaaccccgcccttacaagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330930 - DNA, 1974 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggagcagcacagcaggcagctgcaggagcagtgggaggagctgtcgagtcagaagcccggtaaaccccgcccttacaagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggaggtgcaggtgaaggtgatggaggctgcggaggagctggacgcctggcagagtggccgggaactgtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330931 - DNA, 899 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgcctccccgtccctgtctcccctgacacccgttcctccagaagcccggtaaaccccgcccttacaagccccgcccctagctcttctactacggaggggaactgcagagccagaagagcacggagcagcaactcgcagcccaattggtgacgctgcaggtgcttgagcgggaccctgaggtgtttagtaggggcggagcagcagcatgagctgggccgtgaccacctgggggtgtggcttaaggcaggccctgaaggcgtgggcggggcggggaatgtgggcggagcacaatcgcat

SEQ ID NO: 330932 - DNA, 1313 bp, Homo sapiens
ggtccttctcaagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330933 - DNA, 1909 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330934 - DNA, 1868 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330935 - DNA, 1915 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggaggtgcaggtgaaggtgatggaggctgcggaggagctggacgcctggcagagtggccgggaactgtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330936 - DNA, 2237 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgcctccccgtccctgtctcccctgacacccgttcctccagaagcccggtaaaccccgcccttacaagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggaggtgcaggtgaaggtgatggaggctgcggaggagctggacgcctggcagagtggccgggaactgtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccgtattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccacctt

SEQ ID NO: 330937 - DNA, 1076 bp, Homo sapiens
cgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctggaatggggctggacccagggtggggtggggcagggcgggcggaaggggggccggggtggggtgagtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgcctccccgtccctgtctcccctgacacccgttcctccagaagcccggtaaaccccgcccttacaagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagagacgcggctgttcggcggccctcgcgcgctggccatcaggtgagccgggcggtgggcgcggccgc

SEQ ID NO: 330938 - DNA, 824 bp, Homo sapiens
ttgctttttttgtctctaactcaaactccatcacaagaccttttctcatactcttctctctgcctggagactttgcctagttaaaacttgcttatcctttgatctgtatagaatgttatttccacagagatgcctccccgggtaaggtcatattttcctttcacgtacattggtagcaccttgttcatctcctttctcactgtgatcataaatgcagtggtacattcttcattgagaatgtttaatgtctgcctctgccattagaaaatagccttctgagggcaggaaccgtgtctactttgcagatagaagtacctatttcgtaggatagtgaggattacatgagtttagctcagtgcctagtacataagcacataatgttagttaaatcctgctgtatattgttttggttgtagtagaaggagattatattgatggtgaatacgttaactgggttaagtttaaggaagaattctgactctccttgtccagaaatagatcacctttggagagaagtagctagtctttttgtgacaagggaaagagaaaaatagcttcactcctgtactattcttgacttctgtatctaagtcaaactgtaagaaagcagctttttccaaaatattttctcctcttttccagcaatatttccctaattaaaaaaaaaatcaagtaggtaggcagtttcaaacagagattttcgattggaatttgggaaattaatatatagaattacagatccatatctgttatatcaaccaaagttataaaaatcaagaggatgggatccaagatgatacaacagacatttcatgtcatggcat

SEQ ID NO: 330939 - DNA, 612 bp, Homo sapiens
acagtgatgaagtcacctaatgatgcatttctcagaatgtattcccatcattaagtgatgtatgactgtattccaaaattcaaaaaaaaattcaaaatcaaaaacactttgttcccgagcatttcagataagggatactcaacctgtatatagtatataaaaattagtatataaaaaatcttgtcctcagggagtttataatttgtgaggaacgggtgatgcggttggcattcctggcggatggaatgcaataaacacagtccagagacaggcagtttcattccacctggctctggaacaaagcaggaggggagggccggggagagatgaggtcagccaggctggaaagcagggcgcttaatgccatacaaaggaattgggatcagcttctgggctagtggggggttaaagtaggagtgggggtggtgatacaattaaatcactcgggctgcagtcgacgggaggattagagggaacaagacctggggcagggggatctgtctggatgctggggtccaggcgagagatcgtggggaacccgcagagagatcagatcgtcactgtgtctgtgcagaacgaagtcgacctaggagactccattccgtcatgtac

SEQ ID NO: 330940 - DNA, 424 bp, Homo sapiens
tggacaaagctagtgaatggcacatcaggactagaatttaggtttcctgactcttaagctctctcaccaagaagaaaaatgggagataaactggaacagtgtagattggaattgagccctctcatagctaaggagttgagaaatataaactttaaccccttggacaatgggaacctttgaaggtttctgagcaaaggagtgacaacagggttctcaaaataatatgacatgggtgttaaaaacccttatttggggccaggcacggtggctcacacctgtaatcccagcactttgggaggccgagacgggcggatcacgaggtcaggagatcgagaccatcctggctaaaacggtgaaaccctgtctctactaaaaatacaaaaaattagccgggtgtgttggcaggcacctgtagtcccagcta

SEQ ID NO: 330941 - DNA, 693 bp, Homo sapiens
acatttatgccaaaatatttgaaggttattttcttcatttttctctaatattttcacttttgaaagggaagaaaataattgtataagcatcagccatcttctgcagccttttgcatctattttgttaccttacgagatcatcacagtccttactaaaacaaaaattgtcacaacgtgagtgaatttaatataaactagcatttcccccttcccttagtgaataatcattgtttgtagaaaaagctcccatcattgagtcatgtttgtgatcaacacaaagggtaaatgaaaggaccttagagtggtgaataggtattcctgccttgagggtttctttttcatttaaacattggtgtacaaatacttcagtagctaatgcattcttggttactccttaagatatcttattcttctctaagtttttctaattgcagtgcaatgacaacagtcacatatctgccacttataggaagggagtagaaaaggaggaggctgggaagacagctgtgtaaaggtgagatacgtgagcactgatgaacttcactctccactgcagcccatatatagcctgcagttgtgtgcttctttattttagtctctactaggctctggcaaggaaaacaacatattctgctggaagaaatttttcatttgccactgcaattttttttttttgccactgcaatttttttt

SEQ ID NO: 330942 - DNA, 147 bp, Homo sapiens
tcagcaaatgggagttctaattgctaccaaaagtgaatgtcagggagcagccaccttgagctcttgtgatactgggtacagcccatgataaagtccacaccaacattgcctcattctactcaaggcacttcatcaggcaggccagaa

SEQ ID NO: 330943 - DNA, 535 bp, Homo sapiens
cctcttactatttcttggagtaggcctaggtaaactgtgaggctatttctctttatcttggcacaagagtcagttgttctacaactttcttccttctcctcgtcagccctcttcacctatactcctgtctttggcttttctctacttaataagcctgacgttaggagcatttgatgattttagttatagtagaataactataatgaagcagtttggtgatttgtgtttttttttcagcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccc

SEQ ID NO: 330944 - DNA, 321 bp, Homo sapiens
ctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagctcgcccctgagttaactgggcgagctgcactaactcaggggcgagctgcacgacgcctgtgtgtctggcctttccttcttcttctcttccccggcagcacagtgtggctgtttgtctcctgcccgccaaattagcccagtcgaacgactccacgcagctcgtaatgag

SEQ ID NO: 330945 - DNA, 1476 bp, Homo sapiens
ttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccggttagtttgacgtctttggtaatctctttggcctttacctggtattttgaaaatcctgtttgttcctactttataaattctcacagtcatttaaacagaccataactcctagttcttctgtaattcttctgtatttaactctactagaaagctgaccaaaaaacgaaaacagccagtcccttgtcccgggagtgtcagtgtttagtggcctgcatgcgttttcacgggtcaacttctcttccctgatgtctgtcttccctcctccaggcagagaactgtcttgcaaggttgatggtgcgtttttgcctggttcttgaactcggagaagagagactaggcttctcctgctccttatgcgaactcttaaccagtccatctctctaccttgaccctaaccctcctgctgccctttagagttagctggtgcctctgattcttgacccttttgggggttcctgagcattactacttctcactaatctgccattttcaacagggagttctgtccttcattttaaccta

SEQ ID NO: 330946 - DNA, 1174 bp, Homo sapiens
ttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctagtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccc

SEQ ID NO: 330947 - DNA, 118 bp, Homo sapiens
tgctgcaccttctgctgaccagccccagcagcagcctcgctcacagcagagcacagcagcgtctgttcctaccccaacagcaccgctgcttcctccgcagcctgcaactccagtaagt

SEQ ID NO: 330948 - DNA, 264 bp, Homo sapiens
gtgcttcaaatcagcctttacatatgtgttgccagttatattgtcaattatttattgtatatgctgcaaattttttttctgatttgtcatttgtttcttaactttatagtatttattgtatggtggctgttgtatttatttctgtctcctgttatttcattttgacttaggtgctagtcctatgggagtaaatggaggtgtaggagttcaaacgccgagtcttctttctgactcaatgttgcattcagccataaattctcaaaa

SEQ ID NO: 330949 - DNA, 237 bp, Homo sapiens
aaaatgccagtgtgccctccctgggtcctatgccaacagcagctcaaccatccactactggaattcggaaacagtggcacgaagatattactcaggatcttcgaaatcatcttgttcacaaactgtaagtaagattgtggacacgtctcattcgtaaagagatgttacgtcaacatgttttcaatctcctgggcatttaattactaaaggaatattagcaatttttctgtagcatgg

SEQ ID NO: 330950 - DNA, 396 bp, Homo sapiens
tcctaaatttatatatcatgcctatgtaagtatttccttaattctgttctgaattgctgtcttgttatgttttttattttaacaggcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagt

SEQ ID NO: 330951 - DNA, 1252 bp, Homo sapiens
ttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccc

SEQ ID NO: 330952 - DNA, 922 bp, Homo sapiens
tgaaggtcttcccatggttccatggctcggcacagcccggcaggacactggacacgctgtagcagccacagaggtcacggtcaggtggtccttgaacagcgctcttcccacttgagggcgtccaggtgaaggtgacacctgaggcatctctcaggccggtcagtgtgcacgtgaggttcgcttctgaacctaagagcaggtcctcgagggccggtcggtgcagtgacagtcgggggtggcagcatgagggagatggggtaggtggagcgctccacccgacggggtgggaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccc

SEQ ID NO: 330953 - DNA, 1213 bp, Homo sapiens
tggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggaggtgaggcgccgccaggcgagttcagcgagagttcagccgcattgcattaggcaaatgaggcccggcctgtccacatgccgcctctccctctcggttccctgcgtttctcccgctgcagccggacgcgccgggaatg

SEQ ID NO: 330954 - DNA, 3156 bp, Homo sapiens
  misc_feature (3121)..(3121): n is a, c, g, or t
ctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcaaaaaaaagctttttaatcacctgggtgcaggtgggctgagtccaaaaagagtcagcaaagggtggtgggattatcattagttcttgtaggttngggataggcggtggagttaggagcaattttttgtg

SEQ ID NO: 330955 - DNA, 668 bp, Homo sapiens
gtcgccagctgcccctggcctggcgggggcggaaccgcgcgggatccccacccccacccggaatcctcgccacggagaatccctggagaagccccggatccccggctgggaggaggaagtgctcgttgacccccagccccgcgctgatcccgcccccggcctgcggacttggggagccgctgtactctgcctcggacgccacgagactctagacgggagtcccctcgaggtgaagccgctgagttcccgggccccgccaggcttccctgggagagccgacggaccccccctcccagcacacacaacttccctgcttttcaccgggactggcggagcggccggcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgcgtaccggcctctcagtctgctgttgtagggggtgggagtgggcggtagggcttccactactactcgggggtgagagtcccggggtgtagtggaggtcctgtctctacctttcacttaacccgtgttgcccttgctggacaattgaaccctcccggccgcaccctcc

SEQ ID NO: 330956 - DNA, 3397 bp, Homo sapiens
tctgctccgtaccctccgccccttcagtctggggctccgggtaaagtttcagcctccgcacgtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattcta

SEQ ID NO: 330957 - DNA, 3664 bp, Homo sapiens
  misc_feature (15)..(15): n is a, c, g, or t
tccacgcgcccgacncagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330958 - DNA, 3421 bp, Homo sapiens
aattccctcctggagcccccaccctagctgggggccaggtgggttgggggatgtctcaagagccggtcctttggtcaagcagttctgtgagctggcacttttcctgggaaggtccagagctggccttcagggcaccaaaaaagatgccactcctagatgggccccagctaggtggctgagggggccatgtcctgtgatgctcgcagcgggggaagcaacccgttcggggtgccagcgagcacagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330959 - DNA, 3451 bp, Homo sapiens
ccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330960 - DNA, 3056 bp, Homo sapiens
cccaacagcaaccacgtggccagtggcgccggggaggcagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330961 - DNA, 3206 bp, Homo sapiens
ttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330962 - DNA, 2984 bp, Homo sapiens
  misc_feature (2949)..(2949): n is a, c, g, or t
tggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcaaaaaaaagctttttaatcacctgggtgcaggtgggctgagtccaaaaagagtcagcaaagggtggtgggattatcattagttcttgtaggttngggataggcggtggagttaggagcaattttttgtg

SEQ ID NO: 330963 - DNA, 3201 bp, Homo sapiens
ctcggtaccctgtagctgcacagaggtcacgctcaggtggtccttgaacagcgctcttcccacttgagggcgtccaggtgaaggtgacacctgaggcatctctcaggccggtcagtgtgcacgtgaggttcgcttctgaacctaagagcaggtcctcgagggccggtcggtgcagtgacagtcgggggtggcagcatgagggtcatgcggctggctatggggtggggtggggggtgtgtgcagggccacagctgtgctcatggggcttctggggcagaacttgatgtgtgggttgggtgggcatggagggctggagtgcgtggcaatgccttgcctgcccgtgaacgcgtgctgtgtgcgcgtgcttacaagcctgggtgacctcctcagcagctggcagctctctgtcaggctgggggtggacgaggccctgagcagcctgcagctgccctcttaaccccctctgccctccacagctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330964 - DNA, 4076 bp, Homo sapiens
tggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330965 - DNA, 1954 bp, Homo sapiens
tggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcaaagcggtcgggcctcacgacggtctgcttcgcagcagtgtgcccgagagtgtgcggaggggggcaggcatgccactggaacgcaggccgggagggagggggatgggaacgggaggaagacgggaggggcccgccaagccaaggggaagcgaaaccaggggcg

SEQ ID NO: 330966 - DNA, 173 bp, Homo sapiens
ggctgggtagagggcaggcctgtgggggctggagccaggctgagaaggggtgccatggagaagaaggccctcactctccctcctcccccagaacaacagctcagaacaacgtgtctctctggacattgacctctgggacaagttcagtgaactctccaccaagtgcatcatta

SEQ ID NO: 330967 - DNA, 418 bp, Homo sapiens
atacaaatgtgatggtttatcattgtatctttgtggttttgaaggtgggggtcctaggagtccagaggagtgatggggtgctggaggcttcattggcagcctcctgccctgagtctggctggggagtcccagttttcttaagacttgaatcctgccagcagtggtgaggctgggagaggctcttaggagggacggtgaggcagggtggagcttggtactaaggatggcgacctaggtctctaactgcccctcccctcttctctctctagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaag

SEQ ID NO: 330968 - DNA, 3276 bp, Homo sapiens
  misc_feature (15)..(15): n is a, c, g, or t
tccacgcgcccgacncagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattcta

SEQ ID NO: 330969 - DNA, 3353 bp, Homo sapiens
  misc_feature (15)..(15): n is a, c, g, or t
tccacgcgcccgacncagaagcaggggggaatcctgaatcgagctgagagggcttccccggttctcctgggaaccccatcggccccctgccagcacacacctgagcaggtgtgtgactctggggtgtaacgcgtgggcagctagggatgctgatgctggagaagggatcctggcaccttctgaggcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattcta

SEQ ID NO: 330970 - DNA, 4093 bp, Homo sapiens
tggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330971 - DNA, 3580 bp, Homo sapiens
ccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaacagggttttatttatgaaaccgaaaggcaggggcctcaagcatatgttcggggatttggtgtgcagttggaaattggcagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330972 - DNA, 3695 bp, Homo sapiens
gtcgccagctgcccctggcctggcgggggcggaaccgcgcgggatccccacccccacccggaatcctcgccacggagaatccctggagaagccccggatccccggctgggaggaggaagtgctcgttgacccccagccccgcgctgatcccgcccccggcctgcggacttggggagccgctgtactctgcctcggacgccacgagactctagacgggagtcccctcgaggtgaagccgctgagttcccgggccccgccaggcttccctgggagagccgacggaccccccctcccagcacacacaacttccctgcttttcaccgggactggcggagcggccggcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagatgtacgagagtgtagaagtggggggtcccacccctaatcccttcctagtggtggatttttataaccagaaccgggcctgtttgctcccagagaaggggctccccgccccgggtccgtactccaccccgctccggactccgctttggaatggctcaaaccactccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330973 - DNA, 3092 bp, Homo sapiens
ctgggctaggggccttcttccgctgccgcggtacacccagagctacccccgcctctccccgggaggaggaaggacgccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330974 - DNA, 2945 bp, Homo sapiens
gagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330975 - DNA, 2263 bp, Homo sapiens
  misc_feature (25)..(25): n is a, c, g, or t
  misc_feature (69)..(69): n is a, c, g, or t
  misc_feature (78)..(78): n is a, c, g, or t
acctctcaggtgctgctgacatctntgtgccctgagatggtgatgcgagacgggctctcagcgcatctnctcatctgngagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaaacaaaaaaataccaaaaaaataccacacaaacaaactctacttcacctctcctcccttccaacttaacctattaaatccctctttccacctcataaacaaaaaaaaaaactctggggggggccccggacccacatttccctttaggggcgctttaaatatccaggccctcttttaaaacctcggaactggaaaacccctgcgttcaaaacttattccgttggaaccatatccctttccccgtctgccattttccggccccgttattttcgtcaaatccccttaaattctggcaaaccattttttcttacccaaggcgcaaatggccaatcttttaaaccaagataaccgctaagggtaggttttgtcctct

SEQ ID NO: 330976 - DNA, 1881 bp, Homo sapiens
tggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattcta

SEQ ID NO: 330977 - DNA, 2315 bp, Homo sapiens
agtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaag

SEQ ID NO: 330978 - DNA, 691 bp, Homo sapiens
ccgttaccagaactgtaaactgccttagtaaaagggttgaacagtaagcagtctatagttgcattttagtctggtttcatcatggtgattcaagagtagcctatgtcagtatttggatatgtataatccaggactccatgcactccagcctgagcaacaaagttaaagttaacaaatgttaaagtttaacccttaagcctaagtcttacttttcctagatgcacaaagaaagcagaattcttgctgcatggaattagttgtcagttcaatcatttaggttctctctttaaccgtggaattatgggagaaaaaagcactgttagcttgaaaattgatgtgtaaattccttaagtttgaagactgtgccattgatgtaaggcaggcttgtccaacctgcagcctgcgggccacatgcagcccaggacagctttgaatgtggccccacacaaatttgtaaacttttcctaaaacattatggccaagcatggtggctcatgcctgtaatcccagcactttgggaggccaaggtgggcagatcacttgaggctaggagttcgagaccaacctggccaatgtggtgaaaccttgtctctactaaaaatacaaaacaggcccgcgcagtggctcacgcctgtaattccaacactttgggaggccaacgcaggtggatctcctgaggtctggagttcaa

SEQ ID NO: 330979 - DNA, 3474 bp, Homo sapiens
  misc_feature (934)..(934): n is a, c, g, or t
  misc_feature (938)..(938): n is a, c, g, or t
agtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaaggtgnctgnagcagatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatc

SEQ ID NO: 330980 - DNA, 2625 bp, Homo sapiens
gattttccactcaaaggttctatagcgaaaaatgagctcttacatctataacttttattatggtatatataatgttaattcttttgctttcaagatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatc

SEQ ID NO: 330981 - DNA, 3420 bp, Homo sapiens
agtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctc

SEQ ID NO: 330982 - DNA, 570 bp, Homo sapiens
tgtactttaagttatggaagtctgtctattgggtaagtcatttaaccctagctttttccccccgcagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcatagtgagtgcaatttgtgaagtcaggcaatggctcaaggcgttttaatgctttttaaatttcatcttgaaagattttactaaactttgaaagagcagaaggtaaataaggatcctttggtgatctctgaggtgtttcacctgagtagtctttgttcagaccctgagtggtgatgttgggggtggatgcgggcattacttattgagggcacaagaaaagcgtcaatgtggaaaacataatcttcagtggaaattctgtgtaaattaagtctcttggtatttgagaaatttcgaatctattgtatagtcatttcttgatcattccgttaccagaactgtaaactgc

SEQ ID NO: 330983 - DNA, 483 bp, Homo sapiens
ttaggtataaaatctggccctgctatattattcaagattcctaactataattatttacagtaaacttacttgtttttcttgctaaataaatgatgatgagtggcttagtaccttttatgaaagttcacattcacacttatctttattcatatgttttgaagggaagtcgttgcatatgatgatcccaaaattccacttttcaacacagatgtggacaacctagaagggaagacaccaccagtttttgcttctggtaagtttactcagtcatcagctctgtgttgactttgaaatgttttgttaaacaaaaacataatttttttttgaaaactgctcttacaagcactaccaccacccatgatttcattgttgtgttttatgaccttactttcacaattatggctgaaagttagtgattaaaaccagtaaatcctcctgaaaataagtgcatgttatagatggttgtgatattaggtgatggag

SEQ ID NO: 330984 - DNA, 3459 bp, Homo sapiens
agtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatc

SEQ ID NO: 330985 - DNA, 3506 bp, Homo sapiens
agtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaaattccctagcttaaagttcatcaagcacttattcaggtgggcaagtctaagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatc

SEQ ID NO: 330986 - DNA, 3682 bp, Homo sapiens
  misc_feature (934)..(934): n is a, c, g, or t
  misc_feature (938)..(938): n is a, c, g, or t
agtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaaggtgnctgnagcagatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatcaaaatgagtgcagataagaatcttgaccttgactaaaggtaaggaactaaatgaatgtgggatcctcatcagaaatggtggtgacaccaaaatgtgttgtgatcagctgtgaagtatgaggataatctgagtcaaatgctacgaataattgactgtgttggactggactccaggttattggaatcactcactcaccttccaatgtgct

SEQ ID NO: 330987 - DNA, 672 bp, Homo sapiens
gatatttacaatctgaagatcaaaaataattgttgcttgttgctatgtatatccctccacaaatgtgcatttttacaaaactttatagcttttgtttaataatgaactatctgtacagctctttaaagattataaagcactttcatatatatttttatctcattgaatacacagctcttctctgagttttattcattgatagggaaacaggcttagaatgaagtgtcatgcccaacatgatacaattggaaggtggaagatcaaggtcttctatttgagtcttctctcactaattctggtgtactcccagatatatcctattggcctcccaaatccaagttacccagtcagcatcctgctttctctttctttctaccctgtccagcactagaggataaggaataatttgtgtgggtttgtaaatgactgaaataatggccagtggggtgaggagtgagaaggatggcacagaagtaagtgtctgataaagtctgggagtcaacagcaaaaggtagcacagcaaaagagcaaggtcttttccctaagtggcagaaataacactgaactcaggagtcaggacaaatcagctggaaacatctcatgggcagttaaatcactgcttacagcctgcataaggcttcaccgctccaggcctcagcttcctcgtgggta

SEQ ID NO: 330988 - DNA, 519 bp, Homo sapiens
agatactcaggaggctgaggtgaaaggattgcttgagccagggaggtcaaggctgcagtgagccgtgaaaggccactgcaactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 330989 - DNA, 3313 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaa

SEQ ID NO: 330990 - DNA, 980 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaagcgtacagacaagtccaaaccagacctgggagctcctgggaaaggtgtagctctggaatctaaggaccaaggaaagaatctcggtagccatagaagaactaaggggtcaaaaagcccgaaagatgagtaagaacaacgaatcaggacgtcacgcggcatcgcgcctcggcgaaccggagctcccgcacggagcgagaaactgggcccgggacggcggtatggacctcaggacggggcccggaaaacacagcgagcggcggggagcaaccagacaggacggaacggaaagcgccacggaggcgagaagg

SEQ ID NO: 330991 - DNA, 788 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcaggtactatgttttgtctcatatttgtttttacatacataaatttattgtaaattttaactctcaaagtatgtgtagtaaatgatttacaaataacaaagtgtaccgtattctttagtgtaaattccatgtagccaattctcacagactgctttcagtgatttttgctgggttcttctttctgtacccaacctacagttgcagttgacaaacaagaatagtttggagatgaatattgatattttcctttaagttaagagtaaggtcaaggtggagattgtatatttattctgcattattaactatgtcttatgcctgctttt

SEQ ID NO: 330992 - DNA, 682 bp, Homo sapiens
ggtgtgctgggtcgatctagagatccccaacgatggtcctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagccatcgttgccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttattgcttgcctgtgtgtaaaatggggtccttactgatatcatggaaggcagatggacgtagtcaaggagactgccatgt

SEQ ID NO: 330993 - DNA, 512 bp, Homo sapiens
cactgttagaattatttccttggactgaattaagcaaaatttgctagatatagacattttaacacttgtactgtatattgctgggggcattctaatccagtttcccagattgattctgtcatttgtatatttttaataaatcaagggaaaaataaatcactttttttttttttttgaagacagggtctcgctctgttgtccaggctggagtgcagtggcgcggattacagctcactggagtcttgacttcccaggcacaagcaatcctcccacctcagcctcctaactacctgggactaaaaatgcacgccaccacatccggctaattttttgtattttttgtagagatggggtttcaccatgttggccaggctggtctcaaacttctgggctcaagcgattgtccgccttggcctcctccacaacatcttgacttatgaaataaaaaataaaacttatttatgattcttttacatcattggtgttttaagggcttctggtgtaagtttgaa

SEQ ID NO: 330994 - DNA, 3420 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 330995 - DNA, 4089 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctgacagggtctcgctctgttgtccaggctggagtgcagtggcgcggattacagctcactggagtcttgacttcccaggcacaagcaatcctcccacctcagcctcctaactacctgggactaaaaatgacagtcattttgtttactcattcagccctgttgcaggtcccaataaactcttcataaggttgacagaagcaccctctgccaaggtgacagtcctttcttcacatttagtgtcactactcaagttgttgctccagattactttatcaacattagaaaaaaaattccaagaatcctggtgtacctgtcctagagacaggcactccctggggtagtgatgctaggtgcaccctctctcagtttacaatgtgttagacataataatgcggcaggaaaagaactaggttgcagctgagaaagatgcctctctagaggatggagccatctgaatcatgatctaggccttggtatggagttgccaaatgtatgtctttaggccggtccctaacctctcttgtatgaaaggaagctggacaaaatagtctctctaataaaacagtaatataaaattataagcacttggaattatttcttgaattaaaatggcaatgatctaacaatgtaaattgataagcaacttgaaaatattgccaaataatagaagcaaatcttggccatttgtgggttttttcttgtaagaaaggggaaatctggatctgtactgacacctgcgttcttttctttcaacaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 330996 - DNA, 4551 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagggtaagggccacgggaggcagcagaaaacccatgttgagtggtcaagacatttcacaagcaaggaaagggaaacagtcaagctataagaaagtgtttatgaccatgggcggtcataaatgaagatcctccagcttttggacaccgcagcttatctcttagtctctggtttgtttctcttagaatgattatgactagaaaattaaaggctaatttgtgaacaaaaatcaggatggtttttagaggtactcagatgatatatggagcattgtatactcaggtttatagcttcatcagcttattttattaacttttcacatcctgcttggtcatttcccctgttgtcttgagtataccactattaaataataggacacaaactacattaaccagtattttaatgctttttaaaatgtatttaatagggaatttgtcccattataaaaattatttttatatggctttgcaaaatggatatattttccaaattatgagagtatttatatatgcaatatttatcaagggctataaaaaacatcatttttttcatccattatttccagttttgggaatgtattttaaggaaatcattttaaagaaggaaaagctgtgcatacatagttatttatggcagtattatcttcattagtgctacagcaaaatagaacaacttagaaaatgcagtggagaagaaaaccctacataaatgtgaacacagtcatgtaaaaatatgtgtgtaatgtaaacaaaaatgaattttaaaaaagattatccatgtaaaagtacgaggaccagaagggggaacatggagaagtacaatagtcatggttggttaagactatgggtggaaaactttcttataattttctttttttttttttaataataaaattcctaaaagagggttggaaaactgatgttgggtttggaatttgatattttgtgaattattatatggttgactgaggaagcaaaattcttttgtgtgaagaggatttaatgatcagttatcatgtaccacagtatacaagggtgattccctgaagccacaaacctgtattttccggttctcaaataaatttacagtgtcaactctttatccattcttgttttggatatcatgtcattttcaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 330997 - DNA, 2077 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggagactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 330998 - DNA, 2576 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcaggtgagtttggaatcattttgcagaatttttcaaggtagtgcaccatattattttactgtactcttctctgtatttctgatctcaacgatcaaaaaataatggagtcgaagagtttatttggatctcctgaataaataacattttatattgaagacgggtcattctgtgacttctcaatggatcaaacaatttttctgagttcctataatgttctcagcacgtatagaaattaaaagatttctgattttctaccttacctactcttacctggcagccccattttatatcttactatttaatagatttctttcaggaaattatcaaatataaacttatttgtattttacccttttaatgttgtagcaagtaacactaaataagattatattataaatgctgtcctgaggacattggagctggtcaagaagaagaatacagactacagtagtggtggggaggaggagtgctaaaaagtgtacatacatgtttataactaggacctaatcagagaggttagtctaataaaactttgtataatttgtgaatcttgagaaacagttgagaattgaaaaattcggaatatatgacagactagatcgcctgggaaacccttatactacaaaaatgactatatcttggataccgagggaaaatgtgcttttggatatattgctgagcttgcaggaaattagggtaatttctggtaccagtgggcaaggaggaagaggtatgtcgcccagagggcagatgccaaatagtaacactgctgttgagataccaggcagtaaaaaacagatacagtaggggaacatcagtaaagccagaagtggattcctggttttctataaaataagcctctgacacagtttgttgagaacaaaagaaacacatgaaaaagagg

SEQ ID NO: 330999 - DNA, 2663 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggtaagatactctgtatttcactactgaaaagtacattcttctaatcaaaagcacagatgacttaattttaaattcctgtgtcttaataaaatataagcattcagaaa

SEQ ID NO: 331000 - DNA, 2044 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggatttaatacacaaaacaaaaagaagatacaaaaatgagagctgggcgtggtggcatgcacctgtaatcccatctacttgaggctgtggcaggaggaatgcttgagcccaggagtttgagaccagcctgggctgacatagcaacaccgtctcaa

SEQ ID NO: 331001 - DNA, 1956 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagggtaaagttctttacaaagttcgctggaaaggctatacatcggatgatgatacctgggagcccgagattcacctggaggactgtaaagaagtgcttcttgaatttaggaagaaaatgcagagaacaaagccaaagcagtcaggaaggatattcagagactatccttaaataacgacatatttgaggcgaactctgatagcgatcaggcaaagtgagacaaaagaagatacttccgcaaagaagaaaaagaaaaaattgaggcagagagaaggagaaaagcc

SEQ ID NO: 331002 - DNA, 2715 bp, Homo sapiens
gcgaatagcttcgccctgattggctgcactggcgtcgtatgtagatcggcggtgcttagaagtggccgtcgtattacagcaggcgtcgtgggtgactggcgagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331003 - DNA, 1535 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacactaagcggatcagcgctgatccgcttaagatattcattttctttttccaagttgtcatttttcattgtacatatttcctgtctgagtatagcaatatctgccttcaaaatgcaatt

SEQ ID NO: 331004 - DNA, 2432 bp, Homo sapiens
agctcggtacccccacgatggtcctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331005 - DNA, 2628 bp, Homo sapiens
aacgatggtcctcagctggaagacggcttcgtcccttcccctctttatctagttaactcctacttctccttcaatactcactcagctaaagtctgctgctcttgatttctggcaccaattttacaaggttttgtagagattaggtaaagtaatgtgggtctaacatggtaataatcaaatctgcagactttagctgaggaccatcgttgcaacgatggtctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331006 - DNA, 3457 bp, Homo sapiens
aaagtaagtgtgaaaacagatggttatcacacattaatttcaagggaagggattactcagctatgctgatatgggaacgtgcatcctaaggacctgataaccaagactaaactaaaatgctgcagagttagagaagctgatgcctgtatctgcccaaacgccaaagggccggaggttgagcggggaagagagaggcctctggtccacggactcagccgaggagggtaagggccacgggaggcagcagaaaacccatgttgagtggtcaagacatttcacaagcaaggaaagggaaacagtcaagctataagaaagtgtttatgaccatgggcggtcataaatgaagatcctccagcttttggacaccgcagcttatctcttagtctctggtttgtttctcttagaatgattatgactagaaaattaaaggctaatttgtgaacaaaaatcaggatggtttttagaggtactcagatgatatatggagcattgtatactcaggtttatagcttcatcagcttattttattaacttttcacatcctgcttggtcatttcccctgttgtcttgagtataccactattaaataataggacacaaactacattaaccagtattttaatgctttttaaaatgtatttaatagggaatttgtcccattataaaaattatttttatatggctttgcaaaatggatatattttccaaattatgagagtatttatatatgcaatatttatcaagggctataaaaaacatcatttttttcatccattatttccagttttgggaatgtattttaaggaaatcattttaaagaaggaaaagctgtgcatacatagttatttatggcagtattatcttcattagtgctacagcaaaatagaacaacttagaaaatgcagtggagaagaaaaccctacataaatgtgaacacagtcatgtaaaaatatgtgtgtaatgtaaacaaaaatgaattttaaaaaagattatccatgtaaaagtacgaggaccagaagggggaacatggagaagtacaatagtcatggttggttaagactatgggtggaaaactttcttataattttctttttttttttttaataataaaattcctaaaagagggttggaaaactgatgttgggtttggaatttgatattttgtgaattattatatggttgactgaggaagcaaaattcttttgtgtgaagaggatttaatgatcagttatcatgtaccacagtatacaagggtgattccctgaagccacaaacctgtattttccggttctcaaataaatttacagtgtcaactctttatccattcttgttttggatatcatgtcattttcaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331007 - DNA, 2064 bp, Homo sapiens
ggagtgccaccgctcctggaggctgctctgcaaagtgacgctgctgccccagcatctgcctcacagggtagggaggcacaggcacccttatcctcttttcgcaaatggaaacgtgccactcagaagaattaagggacttatctgaagtcacgtggctaataagtgacagagacaaggagacagtctgtcagctgtgccacagctccatcgtacatttgcaggttcagattcggatctgtgcttgggttgtctcctttaaagcggcagctggggacatttcgagggtgttttgtggtcctgagaggtgtttttgagattcctgagacaaagttgtctacagtgaaggccaggcttacgtatctctgcgcctcgctgaggggctggctcacgggggacagcgtggcatggacagagggcagcagcaggggactgcttagcaaggcctggtgtctgttctgtcttgggactgaagcatcctttttgaagttgcccatttcctgaaaactcagtgctaagatattaactgaatgtagcacacagatttttatgttggcccctgagtcaaagatactccccacttgcatttaagcaatgctgtgtgactcctaacgctgtggcctgacgggccccaaaagttctctatccttcttccatggcctgtgccctctcttcacagaaccgctaagcatgtatggagaagggaccagcacccatgccacagtttacagctaagtaattgttactcctttttacctgacgtaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331008 - DNA, 791 bp, Homo sapiens
  misc_feature (185)..(185): n is a, c, g, or t
caacgatggtcctcagctaccacagccccagagttaatgattgtgacctgctgggcaccatcctgagtgatcagagccacctggggggccccatcttcttcagtcaccatcgccacctgggctgggatgtcatctctctcgtccttcacctccgaaaggtaagctatccgggttcttttggttgncggactctcaacgatggtcctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagccatcgttgcaacgatggtcctcagcttttgatatgtgttcctcactaagcttaatcacttctggcttttgatttaaagtgagaggctgtgactcttcctttcacttgaacactcagaggacactgtagggttaattggcttaatttcaatattgttgtgtctcagggaatagggaggcctgaggtgagggagagagatggtggaacacatgcaacagtgatattctctgttttatatgggtgcagttagtgggacccccaaacaattacaatagatgact

SEQ ID NO: 331009 - DNA, 565 bp, Homo sapiens
  misc_feature (81)..(81): n is a, c, g, or t
  misc_feature (96)..(96): n is a, c, g, or t
  misc_feature (102)..(102): n is a, c, g, or t
  misc_feature (109)..(109): n is a, c, g, or t
  misc_feature (118)..(118): n is a, c, g, or t
  misc_feature (127)..(127): n is a, c, g, or t
  misc_feature (129)..(129): n is a, c, g, or t
  misc_feature (139)..(139): n is a, c, g, or t
  misc_feature (149)..(149): n is a, c, g, or t
  misc_feature (156)..(156): n is a, c, g, or t
  misc_feature (159)..(159): n is a, c, g, or t
  misc_feature (161)..(162): n is a, c, g, or t
  misc_feature (170)..(170): n is a, c, g, or t
  misc_feature (197)..(197): n is a, c, g, or t
tacagcaaaatatacaaaggactgccatttgcaccctttgtgcctgggggaaatgtggcaactgtctaataggaaaagatnaggccttccaaaccntttaangggagcnaaaccacanttaattggngnctggggaaantggaaaaaanaagggtnccntnntgtaaacncaaagtgtttgagaggtggatattttnctttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331010 - DNA, 1865 bp, Homo sapiens
tctaaaggctggggagatggaaatggcagtggagggaagagacttgccttcttagaacttcaattccactgagatggacaacaagacagacacatgggtgtcaggtgcttggtggaagtagagctggaaagcggaggcaggcagagctgcaggtctttgtttggaaggttggcctgggaagccctcactggtattcgacaggcttgtggttcttttctacattaacgttaacacgtactatttttttttcttagactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggtaagccgatgcctcccttcacacttttctatgtgaagtgtgacactatattaacagatttttagacagaatcctttcttggaacaaaactttaaggaaattccattacgtgtaataattctgcagaccggttaacagtagagccactctggtggaagagacatccagctgacaccccatccctgttttaacacccatatagagcatggaagttaggtcttaataatcacactagttctcaatgagttttattaaaattcagcgtcaagattctaagcctagaatgttttttccctgaattttgttgtttgtaatagtctttgccctttgaaaaagaaaaaaatagtcttgctccatagtaaagctgagtggaaagagatggagaagccactttcctctctagcctctgctcgacagaccctctccaggcagggctgcggctggccctctctacacgtggcgccaggtagacgtggaggcagtgcagtctgccgaggggaggaagccgggctctggctttttttgcttagaaactcctgttccccattttgtaaatggtttgtattcattcctggaaaatgtatttaagaacatatagccctgcccctgaaagagccgtttgtaatatcttagtgttgagagaacttatcaggtggttgctgttgttttgagatggagtctccctgtgtcacccaggctgcagtgcatggcatgatcttggctcactgcaacctctgccttctggcttcaagtgatccgcctgcctcagcctcccaaagtgctgggattacaggcgtgagccaccgtgcgcgttcagtaatttatagttttgattattcgggtggaccatctgcattgccaggtatgagtaccagagaacgatgccctgagctggccctggtgaacctgagcccccactgacacctacaactgctgggcctgcagttttctcagcatgtgtacaatgtctgcatccaccaacttttttttttttttttcaggagtctcacactgttccccaggctggagtgcagtggtgcgatctcggctcactgcaacctccgcctcctgggttcaagcaattctcctgcctcaacctcccgagtagctggaattacaggtgcccaccatgatacccagctaaattttgtgttcttagtagagatgggggtttcaccatattggccaggctgatcttgaactcctggcctcaagtgatctgcctgcctctgcctcccaaagtgctgggattacagacatgagccaccatgcctggccaatttttggttatgtattaatcagaaaaattggaaggggcaaaagggtatgtggaagaaaatggaaaaccactcagacccacacccaaagatgcccaccacaggaatgtccctgggacgtgtgcacattcagcagcagtgtttaaataccagttaaataacttcagtgtagaaaatca

SEQ ID NO: 331011 - DNA, 658 bp, Homo sapiens
  misc_feature (185)..(185): n is a, c, g, or t
caacgatggtcctcagctaccacagccccagagttaatgattgtgacctgctgggcaccatcctgagtgatcagagccacctggggggccccatcttcttcagtcaccatcgccacctgggctgggatgtcatctctctcgtccttcacctccgaaaggtaagctatccgggttcttttggttgncggactctcaacgatggtcctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagccatcgttgcaacgatggtcctcagctcaaacgagagatacattacagatggttgtattataaacctaatcttaagaaaacttaccaagcaaatggttaaagactgattttttggtgatctgataaaaaggctggaaatcgtgaatca

SEQ ID NO: 331012 - DNA, 1205 bp, Homo sapiens
  misc_feature (1158)..(1158): n is a, c, g, or t
ggagtgccaccgctcctggaggctgctctgcaaagtgacgctgctgccccagcatctgcctcacagggtagggaggcacaggcacccttatcctcttttcgcaaatggaaacgtgccactcagaagaattaagggacttatctgaagtcacgtggctaataagtgacagagacaaggagacagtctgtcagctgtgccacagctccatcgtacatttgcaggttcagattcggatctgtgcttgggttgtctcctttaaagcggcagctggggacatttcgagggtgttttgtggtcctgagaggtgtttttgagattcctgagacaaagttgtctacagtgaaggccaggcttacgtatctctgcgcctcgctgaggggctggctcacgggggacagcgtggcatggacagagggcagcagcaggggactgcttagcaaggcctggtgtctgttctgtcttgggactgaagcatcctttttgaagttgcccatttcctgaaaactcagtgctaagatattaactgaatgtagcacacagatttttatgttggcccctgagtcaaagatactccccacttgcatttaagcaatgctgtgtgactcctaacgctgtggcctgacgggccccaaaagttctctatccttcttccatggcctgtgccctctcttcacagaaccgctaagcatgtatggagaagggaccagcacccatgccacagtttacagctaagtaattgttactcctttttacctgacgtaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacgtaagtgagaagcgactgtgccacagttaagtcacatatcatacatctgtttatgtagacatattataattggagtggcctgtgtgtaactgctcagaaaaacatccagcacaagtcctgatggttttgtttccagtagatcacagatttaataaatggcatatgaattatttttctgcaagttatttaactctcagaaaatttcaaacttaacactggcctatctgggagtattttcctntaaatattaagtatgctctaatttggttagcaaatgtcgctggctta

SEQ ID NO: 331013 - DNA, 836 bp, Homo sapiens
aacgatggtcctcagctggaagacggcttcgtcccttcccctctttatctagttaactcctacttctccttcaatactcactcagctaaagtctgctgctcttgatttctggcaccaattttacaaggttttgtagagattaggtaaagtaatgtgggtctaacatggtaataatcaaatctgcagactttagctgaggaccatcgttgcaacgatggtctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgtgcccggcctcaaaatagttttcttgtgggatttcagggggaaaatcacttgtaccagataccacatgatttggttgggtggcgtgggaaggcgggtcttggcccttctcaggttcatccatg

SEQ ID NO: 331014 - DNA, 3545 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctgacagggtctcgctctgttgtccaggctggagtgcagtggcgcggattacagctcactggagtcttgacttcccaggcacaagcaatcctcccacctcagcctcctaactacctgggactaaaaatgacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331015 - DNA, 3801 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttatatctcaagtctcaaaactttaaaagacagtagatatttgtggttttctagctaaatgagggccaagattggactttttcaactaaattgaatcatgtagtatatctgatttcatagctttctgggggaaaagggaggatttgaattagcagcagtgcaggtcaggagcagtaaagaagacagtaggaggagtccaactatagatgtgaatgaacagcctcagaggaacacatgagaaggtgacctgctgtttatcaggaaggcggggctttctctctaagatacaaaccaaataggaatcgtcaaatagttcaaattatccgggggaaaaagcctgagcaatgatccctctggaaaacaaagcagttctcaggcagcacctt

SEQ ID NO: 331016 - DNA, 3884 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggtaagccgatgcctcccttcacacttttctatgtgaagtgtgacactatattaacagatttttagacagaatcctttcttggaacaaaactttaaggaaattccattacgtgtaataattctgcagaccggttaacagtagagccactctggtggaagagacatccagctgacaccccatccctgttttaacacccatatagagcatggaagttaggtcttaataatcacactagttctcaatgagttttattaaaattcagcgtcaagattctaagcctagaatgttttttccctgaattttgttgtttgtaatagtctttgccctttgaaaaagaaaaaaatagtcttgctccatagtaaagctgagtggaaagagatggagaagccactttcctctctagcctctgctcgacagaccctctccaggcagggctgcggctggccctctctacacgtggcgccaggtagacgtggaggcagtgcagtctgccgaggggaggaagccgggctctggctttttttgcttagaaactcctgttccccattttgtaaatggtttgtattcattcctggaaaatgtatttaagaacatatagccctgcccctgaaagagccgtttgtaatatcttagtgttgagagaacttatcaggtggttgctgttgttttgagatggagtctccctgtgtcacccaggctgcagtgcatggcatgatcttggctcactgcaacctctgccttctggcttcaagtgatccgcctgcctcagcctcccaaagtgctgggattacaggcgtgagccaccgtgcgcgttcagtaatttatagttttgattattcgggtggaccatctgcattgccaggtatgagtaccagagaacgatgccctgagctggccctggtgaacctgagcccccactgacacctacaactgctgggcctgcagttttctcagcatgtgtacaatgtctgcatccaccaacttttttttttttttttcaggagtctcacactgttccccaggctggagtgcagtggtgcgatctcggctcactgcaacctccgcctcctgggttcaagcaattctcctgcctcaacctcccgagtagctggaattacaggtgcccaccatgatacccagctaaattttgtgttcttagtagagatgggggtttcaccatattggccaggctgatcttgaactcctggcctcaagtgatctgcctgcctctgcctcccaaagtgctgggattacagacatgagccaccatgcctggccaatttttggttatgtattaatcagaaaaattggaaggggcaaaagggtatgtggaagaaaatggaaaaccactcagacccacacccaaagatgcccaccacaggaatgtccctgggacgtgtgcacattcagcagcagtgtttaaataccagttaaataacttcagtgtagaaaatca

SEQ ID NO: 331017 - DNA, 2889 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctgacagggtctcgctctgttgtccaggctggagtgcagtggcgcggattacagctcactggagtcttgacttcccaggcacaagcaatcctcccacctcagcctcctaactacctgggactaaaaatgcacgccaccacatccggctaattttttgtattttttgtagagatggggtttcaccatgttggccaggctggtctcaaacttctgggctcaagcgattgtccgccttggcctcctccacaacatcttgacttatgaaataaaaaataaaacttatttatgattcttttacatcattggtgttttaagggcttctggtgtaagtttgaa

SEQ ID NO: 331018 - DNA, 3035 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagggtaagggccacgggaggcagcagaaaacccatgttgagtggtcaagacatttcacaagcaaggaaagggaaacagtcaagctataagaaagtgtttatgaccatgggcggtcataaatgaagatcctccagcttttggacaccgcagcttatctcttagtctctggtttgtttctcttagaatgattatgactagaaaattaaaggctaatttgtgaacaaaaatcaggatggtttttagaggtactcagatgatatatggagcattgtatactcaggtttatagcttcatcagcttattttattaacttttcacatcctgcttggtcatttcccctgttgtcttgagtataccactattaaataataggacacaaactacattaaccagtattttaatgctttttaaaatgtatttaatagggaatttgtcccattataaaaattatttttatatggctttgcaaaatggatatattttccaaattatgagagtatttatatatgcaatatttatcaagggctataaaaaacatcatttttttcatccattatttccagttttgggaatgtattttaaggaaatcattttaaagaaggaaaagctgtgcatacatagttatttatggcagtattatcttcattagtgctacagcaaaatagaacaacttagaaaatgcagtggagaagaaaaccctacataaatgtgaacacagtcatgtaaaaatatgtgtgtaatgtaaacaaaaatgaattttaaaaaagattatccatgtaaaagtacgaggaccagaagggggaacatggagaagtacaatagtcatggttggttaagactatgggtggaaaactttcttataattttctttttttttttttaataataaaattcctaaaagagggttggaaaactgatgttgggtttggaatttgatattttgtgaattattatatggttgactgaggaagcaaaattcttttgtgtgaagaggatttaatgatcagttatcatgtaccacagtatacaagggtgattccctgaagccacaaacctgtattttccggttctcaaataaatttacagtgtcaactctttatccattcttgttttggatatcatgtcattttcaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331019 - DNA, 2867 bp, Homo sapiens
tagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcacccgaggaggacaaagaaaccaaaagaaatgaatccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331020 - DNA, 2511 bp, Homo sapiens
gggtgatgctgcaggcactctaccggatctatgcaccattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331021 - DNA, 1598 bp, Homo sapiens
tacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagccatcgttgcaacgatggtcctcagcttttgatatgtgttcctcactaagcttaatcacttctggcttttgatttaaagtgagaggctgtgactcttcctttcacttgaacactcagaggacactgtagggttaattggcttaatttcaatattgttgtgtctcagggaatagggaggcctgaggtgagggagagagatggtggaacacatgcaacagtgatattctctgttttatatgggtgcagttagtgggacccccaaacaattacaatagatgact

SEQ ID NO: 331022 - DNA, 2811 bp, Homo sapiens
  misc_feature (185)..(185): n is a, c, g, or t
  misc_feature (322)..(322): n is a, c, g, or t
caacgatggtcctcagctaccacagccccagagttaatgattgtgacctgctgggcaccatcctgagtgatcagagccacctggggggccccatcttcttcagtcaccatcgccacctgggctgggatgtcatctctctcgtccttcacctccgaaaggtaagctatccgggttcttttggttgncggactctcaacgatggtcctcagctctacgatggtcctcagctcaacgatggtcctcagctcaacgatggtcctcagctcaacgatgctcctcagctcaacgatggtcctcagctcaacgatggtcctcagctcancgatggtcctcagctcaacgatggtcctcagctcaacgatggtcctcagctcaacgatggtcctcagctcaacgatggtcctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaatggggattatattactgtaaaagttgcacttaattcaaatgaagaatataacctggaccaagaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331023 - DNA, 1330 bp, Homo sapiens
agatctggtgcctctcgtcgtttgggcgccctttacggggcttttttccgtgggccctcgtccagtgtttccgtgttttctcccctggggtagcccgaatctggggcacttcctgggccgcactccctggggtagtgatgctaggtgcaccctctctcagtttacaatgtgttagacataataatgcggcaggaaaagaactaggttgcagctgagaaagatgcctctctagaggatggagccatctgaatcatgatctaggccttggtatggagttgccaaatgtatgtctttaggccggtccctaacctctcttgtatgaaaggaagctggacaaaatagtctctctaataaaacagtaatataaaattataagcacttggaattatttcttgaattaaaatggcaatgatctaacaatgtaaattgataagcaacttgaaaatattgccaaataatagaagcaaatcttggccatttgtgggttttttcttgtaagaaaggggaaatctggatctgtactgacacctgcgttcttttctttcaacaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcactccagcctgggtgacagaatgagaccttgtctcaaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 331024 - DNA, 807 bp, Homo sapiens
  misc_feature (185)..(185): n is a, c, g, or t
  misc_feature (322)..(322): n is a, c, g, or t
caacgatggtcctcagctaccacagccccagagttaatgattgtgacctgctgggcaccatcctgagtgatcagagccacctggggggccccatcttcttcagtcaccatcgccacctgggctgggatgtcatctctctcgtccttcacctccgaaaggtaagctatccgggttcttttggttgncggactctcaacgatggtcctcagctctacgatggtcctcagctcaacgatggtcctcagctcaacgatggtcctcagctcaacgatgctcctcagctcaacgatggtcctcagctcaacgatggtcctcagctcancgatggtcctcagctcaacgatggtcctcagctcaacgatggtcctcagctcaacgatggtcctcagctcaacgatggtcctcagctctcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggagccatcgttgagctgaggaccatcgttgagctgaggaccatcgttgagctgaggaccatcgttgagctgaggaccatcgttgagctgaggaccatcgttg

SEQ ID NO: 331025 - DNA, 357 bp, Homo sapiens
tgtgtatattttacaacaataaaaaaaatttatatatgtagaaaaaaaatctaggatttacatctaactattattagtattagtagttatgaataaagaaataagaatctcttttggtagaaaaaggttggccaggcgtggtgtctcatacctgtaatcacagcactttgggaggctgaggcgggcagatcacctgaggtcaggagttcgagaccagcctggccaacatggtgaaaccccatctctactaaaaatacaaaaaaattagccaggcgtggttgtgggtgcctgtaatcccagctactagggaggcttaggcaggagaatcacttgaacctgagaggcggaggttgccgt

SEQ ID NO: 331026 - DNA, 529 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaa

SEQ ID NO: 331027 - DNA, 771 bp, Homo sapiens
  misc_feature (581)..(581): n is a, c, g, or t
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaaaaaaaaaaaaaacaaaaaaaacaaaaaacttgtgtgggccgctccgccccnagaaaaagtctttcacaccatttcgtttgggccgccgccgcatgggtaggtgacctgggccatcactgttcgcaggagactcgggtccggcactgggccggggtttccccataaacaagcccgccgcaacccctgtctgacatccagagggttcgagcctacggtttcacgggtccaggaccgatatcgg

SEQ ID NO: 331028 - DNA, 893 bp, Homo sapiens
aacaactttgacctttctacaaaacttctaatagtgtgaaatgtctgaattaatgcttttcacactaggtcagcttaaaaaacttacagttcagctagcctaccccctccttcatcttcctacagcttatttgtagcctggaaagactattttggtgatagcattagaaagggtcctggaaacaaaatacaaagcatgatagagcatatgaaatctgtttctcttcattgggaatactgcatggttctgatggtcacacttgacaatgaagctaaaaacagtccagagaagaatagatgaaaatgacaaaggagaaaaagtggcttctctgacagttagattaggttagattagttagattaagattaggattcttaaataaacagaaagctaattagtgatatgagccttctacattctgaaggatttgaacaagatcattagaattcaaaaaacaccagaaatgaaagatctttcctgaagctgtttaggaatattcatgatatacccttaactgttctagagaacaaaatgcgtctgtgctccttcacaaaagtccctatgaatttgtttctcaatgtgatccttcttaagttctataactttttgttttcattaattttaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaa

SEQ ID NO: 331029 - DNA, 829 bp, Homo sapiens
gataaatccatccggcgtcgcgcgtgccctgcattcggctaaagtatgatcagtgcgctcaatatgtattgatatgtccagtacgaagcacttgctgcgatctacttgaccttaggatggacctctcgtgcagtatcctccagcccagaataataacaagacagtcactccgtgccgggaaaaaaccgcagggcggtgtgcctggcataacgacacagtacgccagggatttgggagcttcatagaaggctcccatccatcgtaggaactcataatctaccatggtgttcagtagcagaagcatccgcatatcgaccggtagcggcctccagtcgcaatggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatggtggaactattagtggtattccctgggcctaaaattaaccctcatcttatttaaatcattacacatagaaaaaaagaacaggagagaaagacaaagacaaaaacagtgtgcaagggcgcgatcgaggcacccagcgaaaaagctcgttacaaaagcacatgacgtagggcgcgcgagggccccacaggggaaaggggaaagagtgggcaaaggagggtacccaggagaagaaccggggagaaaaaaggaagggggaaacagcacaaag

SEQ ID NO: 331030 - DNA, 214 bp, Homo sapiens
  misc_feature (42)..(42): n is a, c, g, or t
  misc_feature (86)..(86): n is a, c, g, or t
caagttctactgagatatttgtgaaaaaaatctatgtttacnattcaattgttgtatattactacccctttagttttcaagttcanaattattgataggaaagaaaaacttatccaggaaggaaaattggatcgaacatttcacctctcatattaagtctggcaatgatgactatatgtattcctgcctaaataaatcatctattaatcattaa

SEQ ID NO: 331031 - DNA, 698 bp, Homo sapiens
  misc_feature (569)..(569): n is a, c, g, or t
  misc_feature (572)..(572): n is a, c, g, or t
  misc_feature (574)..(574): n is a, c, g, or t
  misc_feature (581)..(582): n is a, c, g, or t
  misc_feature (586)..(586): n is a, c, g, or t
  misc_feature (589)..(589): n is a, c, g, or t
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaaaacacacaaaaaaacaaacaaacaaaaaaaattttgggnggncngggcccnngaanaantttttttaaaccctttggttgggcgggcggggccccgggggtgtgaccctgggccaaacgggtcccaggaaatccggggtcgcctgggttggtttcccccaataaaaac

SEQ ID NO: 331032 - DNA, 780 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaaaaaaaaaaaaaaaaaaaaaaaaaaaaaaaaaaaaaaaaaaaaaaaaaacaaaaaaaaaaaaaaaaaaaaagaaccttgtgggccgcttggcccaagtgaattttagattggagaaggtttatgctggcggccgaatttggggctaattggccaatttccccttatggggggcggtttacaattcatggcccgcggtttaacaacggcggaactggaaaaccttggcggtcccaacttaaatcgcttggaa

SEQ ID NO: 331033 - DNA, 1479 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatgtatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaa

SEQ ID NO: 331034 - DNA, 1843 bp, Homo sapiens
aacaactttgacctttctacaaaacttctaatagtgtgaaatgtctgaattaatgcttttcacactaggtcagcttaaaaaacttacagttcagctagcctaccccctccttcatcttcctacagcttatttgtagcctggaaagactattttggtgatagcattagaaagggtcctggaaacaaaatacaaagcatgatagagcatatgaaatctgtttctcttcattgggaatactgcatggttctgatggtcacacttgacaatgaagctaaaaacagtccagagaagaatagatgaaaatgacaaaggagaaaaagtggcttctctgacagttagattaggttagattagttagattaagattaggattcttaaataaacagaaagctaattagtgatatgagccttctacattctgaaggatttgaacaagatcattagaattcaaaaaacaccagaaatgaaagatctttcctgaagctgtttaggaatattcatgatatacccttaactgttctagagaacaaaatgcgtctgtgctccttcacaaaagtccctatgaatttgtttctcaatgtgatccttcttaagttctataactttttgttttcattaattttaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatgtatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaa

SEQ ID NO: 331035 - DNA, 1586 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatgtatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaa

SEQ ID NO: 331036 - DNA, 636 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaa

SEQ ID NO: 331037 - DNA, 492 bp, Homo sapiens
gcggccgcctactactactaaattcgcggccgcgtcgacccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaa

SEQ ID NO: 331038 - DNA, 1086 bp, Homo sapiens
  misc_feature (628)..(628): n is a, c, g, or t
  misc_feature (631)..(631): n is a, c, g, or t
  misc_feature (634)..(634): n is a, c, g, or t
  misc_feature (640)..(640): n is a, c, g, or t
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaaaaaaaaaaaaaaaaaaaaaaaaaaaaaaaaaaaaaaaaaaaaaaaaaacaaaaaaaaaaaaaaaaaaaaagaaaaaaaaaaaaaaacaaaaaaaaagnganaanaaaganaaacacaacgaaatcacaggcgagaacaacgagaccagaaggagagagcggaccacacacgcgacgcgcgcgcgcgccagacagaccgccgacgggtgcggggcggacgggcggagagcgagggagcgagaagagagggcgaaggtcaagagagagcggcgaagagaagcgaggagacacgaccaacggcctaggagagagaaggagacagggagcgacgccgcgaagcgacgaaggcgagcggacagagcaagaacgcgatacatatcacgcactaagatttgatgtcataggaggaggggtgagagaggaaaggcggcggggggcggaggtcacaggcgagagggctgaagtaagaaggcgcgggaggacacgaacgccaacagaaaggagggggcgggcgcgcaacgcacggagggcgtggaggagcggggggggggtagggg

SEQ ID NO: 331039 - DNA, 705 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaagtagtagtttctctttcttagtattaccttgattcaatgttaaaaactattaacaccctaacaacacagaagcagacgcagcccgtgttgggaatctgctgtcagagtgacagcaaacatttgctgtacattgaatgaatgaacataaacttcattaaactgtgagctcttagaa

SEQ ID NO: 331040 - DNA, 1425 bp, Homo sapiens
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaactgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatgtatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaa

SEQ ID NO: 331041 - DNA, 1193 bp, Homo sapiens
  misc_feature (735)..(735): n is a, c, g, or t
  misc_feature (738)..(738): n is a, c, g, or t
  misc_feature (741)..(741): n is a, c, g, or t
  misc_feature (747)..(747): n is a, c, g, or t
gcgcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaaaaaaaaaaaaaaaaaaaaaaaaaaaaaaaaaaaaaaaaaaaaaaaaaaacaaaaaaaaaaaaaaaaaaaaagaaaaaaaaaaaaaaacaaaaaaaaagnganaanaaaganaaacacaacgaaatcacaggcgagaacaacgagaccagaaggagagagcggaccacacacgcgacgcgcgcgcgcgccagacagaccgccgacgggtgcggggcggacgggcggagagcgagggagcgagaagagagggcgaaggtcaagagagagcggcgaagagaagcgaggagacacgaccaacggcctaggagagagaaggagacagggagcgacgccgcgaagcgacgaaggcgagcggacagagcaagaacgcgatacatatcacgcactaagatttgatgtcataggaggaggggtgagagaggaaaggcggcggggggcggaggtcacaggcgagagggctgaagtaagaaggcgcgggaggacacgaacgccaacagaaaggagggggcgggcgcgcaacgcacggagggcgtggaggagcggggggggggtagggg

SEQ ID NO: 331042 - DNA, 432 bp, Homo sapiens
gatatgaggcagaaattagttttgtgtgcacataaaacataaaacaaatgagtggagattttgatcttattttccctacatggagttgctagttaattcggttactctaattatttggaaacacggcatataaaatatagactaagaactacaaacttcaaagccatcttttgacaattttgccttaagggtcacgttctctttaaagttgctgactaaattgcacctgcagaaattgttcccataaagagacactcaggagatcagattgattgcgagggtgtgtgagggctgtgtggtccaccggccagagccccccaggcccagctaggattctgagtggcagccccatctctgccctgactcttgggatgacctccttagaaccatttgaccccttagaacgttattttctcacttatcatactgtga

SEQ ID NO: 331043 - DNA, 1384 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331044 - DNA, 344 bp, Homo sapiens
ctacatgttcacaactcaacagcacgtacactacatgtagtgtacggcccaccagttcacaactcaacagcacgtacactacatgttcaaatctgtaatacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331045 - DNA, 123 bp, Homo sapiens
tcaagcttctaacgatgtacggggacatggctttttagaatttcgttacgtatgttaagatttgtgtacaaattgaaatgtctgtactgatcctcaaccaataaaatctcagttatgaaaata

SEQ ID NO: 331046 - DNA, 4403 bp, Homo sapiens
  misc_feature (1622)..(1622): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacgttgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331047 - DNA, 4485 bp, Homo sapiens
  misc_feature (1704)..(1704): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctgtaagtaaagcgagccccgtaaccgttcgttttccgcgggtcgtcccgggtgaggacgctcagtgctgcttttgcctttcagaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacgttgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331048 - DNA, 3848 bp, Homo sapiens
  misc_feature (1622)..(1622): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331049 - DNA, 3509 bp, Homo sapiens
  misc_feature (728)..(728): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacgttgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331050 - DNA, 1477 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagaggtgagtgcgggccttctgcggggggtggtgggtttcccgtgagccgctggcctgccttctcttctcgctgactctcctttttctttctccaagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331051 - DNA, 1884 bp, Homo sapiens
  misc_feature (1492)..(1492): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaaaaaaatttgggggatctatgggggggggggaaaaaggggtaggaagggcctgggcattagctggtttcttggacccagctttctggtacaaangggggtagatctggcgcgggtctccctataggggagctcggaataaattccggataacgccagggttaaccttgggataatgtgtagacgggaacaaagcacctagcccaacgcggcgatagcccggccagagcacccccccaggggggctgacgcaaattcgggacccacaacagacgggtcggaaaaagctaatagagctcgcacacaacacccagcgcccacgaacccaacacagcagacaataacactgcaccacacaaatatgaaccacgactcacaaaaccagagccgacacaccacacacacaccgccatgatcaacgactcacaagacaacagctaacgcacccacagcatccagtgaatcatcatacctaaagcaaactgtcc

SEQ ID NO: 331052 - DNA, 1189 bp, Homo sapiens
  misc_feature (87)..(87): n is a, c, g, or t
  misc_feature (91)..(93): n is a, c, g, or t
  misc_feature (96)..(96): n is a, c, g, or t
  misc_feature (100)..(102): n is a, c, g, or t
gagtgtcctctgctcctagaggcccagcctctgtgtccctgtgacctgcagatattgggagatccacagctaagacgccgggactcncggnnnccnagannnggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331053 - DNA, 2297 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331054 - DNA, 1524 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaatacactaacaccacccacaccgcgagacaagcgcccaccccgcaatccacactcgttactcaccccatccacatcaccgctcttgcgcacacgcagccaccacataagggcaccctcctcgcgagccgcaactccttccccc

SEQ ID NO: 331055 - DNA, 2004 bp, Homo sapiens
ccttcagtttcgctacgacaactcatacacctcctatgaaaaaactctaccactcaccctagcattacttatatgatatgtctccatacgctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacgttgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331056 - DNA, 1393 bp, Homo sapiens
gcggccgcgggggcgggcgttctggaacgtttggcggccgggggagctgagggggctattcgaacggggcggcgggaagccgtgacgtcacgcggccgggcattgttctcggggccgggcgggcccgcgagtcctgggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331057 - DNA, 1618 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331058 - DNA, 1498 bp, Homo sapiens
gcggccgcgggggcgggcgttctggaacgtttggcggccgggggagctgagggggctattcgaacggggcggcgggaagccgtgacgtcacgcggccgggcattgttctcggggccgggcgggcccgcgagtcctgggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331059 - DNA, 1020 bp, Homo sapiens
  misc_feature (34)..(34): n is a, c, g, or t
  misc_feature (58)..(58): n is a, c, g, or t
gcgggcaccgcgtctggccagcacacagacaccncccgtttagggtaaaccccttcanacaaaatgctgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331060 - DNA, 1021 bp, Homo sapiens
  misc_feature (89)..(89): n is a, c, g, or t
  misc_feature (95)..(95): n is a, c, g, or t
caagggcgactccatggcagccccttcggtggagctgacctttttcttgggcatcctggcagcagggaaggtgggtgccaggtgcctgnctggcncgcggtgtgcctacagccttcgcgaagctgggctgcctggccgctgccactcctcccgccaccggagctgctctcgctatgttggccaggctggtctcgaactccagaccttagatgaaccacctgcctcggcctcccaaagtgctgggattacaggcgtgagccactgcgcccggaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331061 - DNA, 1377 bp, Homo sapiens
  misc_feature (1168)..(1169): n is a, c, g, or t
  misc_feature (1225)..(1226): n is a, c, g, or t
  misc_feature (1238)..(1239): n is a, c, g, or t
  misc_feature (1277)..(1277): n is a, c, g, or t
  misc_feature (1320)..(1320): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtggacaattgagacgttcatatttctacactnngttggtgggatgtcgtcaattatgttacaaccatgtgtggaagacttctggcaatnntcctcaagaatnnctagaactagaattaccattgtgacccagcaatcccanttacgtgggtatatacccaagaggatttataaatcattctacntatagacacatgcacacatatgtttactgcagtgctgttcacaacagcaaagacttg

SEQ ID NO: 331062 - DNA, 3796 bp, Homo sapiens
  misc_feature (1622)..(1622): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaattaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331063 - DNA, 852 bp, Homo sapiens
tctatcttaatctcacagaaatttctatgggccaggctgacttagaacgtcatgtcgggaagagaagtgaggccggtctaggaagcaggagagatcatcactggtccattagcaacgtttccagtgtgtgctggaccaggggaagcacattccaagtactgtcagccattactgagataataccatacatgttaataagactaagctcttaaaaggcacgtgtcctacacaagtaatatcacaatccctcgtagaacaggcacctctatccttaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331064 - DNA, 3366 bp, Homo sapiens
  misc_feature (1622)..(1622): n is a, c, g, or t
  misc_feature (3366)..(3366): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaacattcaaagatgggggtaggttttattcctatatacaaagatattaaatgcattatggagccaccctgcatttatggtctgcattttacttctttcn

SEQ ID NO: 331065 - DNA, 1264 bp, Homo sapiens
gcggccgcgggggcgggcgttctggaacgtttggcggccgggggagctgagggggctattcgaacggggcggcgggaagccgtgacgtcacgcggccgggcattgttctcggggccgggcgggcccgcgagtcctgggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331066 - DNA, 4552 bp, Homo sapiens
  misc_feature (1771)..(1771): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgccgccacgatgcccaagaggaaggtcagctccgccgaaggcgccgccaaggaagaggtgagtgcgggccttctgcggggggtggtgggtttcccgtgagccgctggcctgccttctcttctcgctgactctcctttttctttctccaagcccaagaggagatcggcgcggttgtcagctgtaagtaaagcgagccccgtaaccgttcgttttccgcgggtcgtcccgggtgaggacgctcagtgctgcttttgcctttcagaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacgttgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331067 - DNA, 1358 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331068 - DNA, 1275 bp, Homo sapiens
cgcttcacgcaggcctgcgaagctggagcccctggatagcctttcttgccgacagaggcgggagaaatttgctacttcctgtataccttatccttctcccttcccagtctaagatacgaactataaatgttcgaacccaattcaccccggaggggaggggccagataccagtggcctgaaggcgcccaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331069 - DNA, 1466 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctgtaagtaaagcgagccccgtaaccgttcgttttccgcgggtcgtcccgggtgaggacgctcagtgctgcttttgcctttcagaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331070 - DNA, 1414 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataatattttgaagcacatggaaaaaaaaaaag

SEQ ID NO: 331071 - DNA, 1489 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331072 - DNA, 1415 bp, Homo sapiens
gcggccgcgggggcgggcgttctggaacgtttggcggccgggggagctgagggggctattcgaacggggcggcgggaagccgtgacgtcacgcggccgggcattgttctcggggccgggcgggcccgcgagtcctgggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatcttttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 331073 - DNA, 2687 bp, Homo sapiens
  misc_feature (1622)..(1622): n is a, c, g, or t
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttaattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattntgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaaatttgtgtacaaattgaaatgtctgtactgatcctcaaccaataaaatctcagttatgaaaata

SEQ ID NO: 331074 - DNA, 472 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgctataaaatggtgaaagcttccttctaaactgccccaagtgttgaagtcttcactttattttgttctgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaaaaaaaaaa

SEQ ID NO: 331075 - DNA, 4391 bp, Homo sapiens
tggtgtggtgcggcgaacctggcttacgcgttttcctgagccggcagatagtagtcctcctgtagtgcaccccgcttggctccacattgctcccgggctcagcgtgacaccacgcgtatggggacggagcccgagccccgagtagggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgccgcgcaacagcaacagcaacagcagcagcagcagcagcagcaacagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggagggacccccagagctgaaccgtcagagccccaattcttcttcagcggcggcgtcggtggcgtctcggcgtggaacgcacggtgggctggttacggggctgcccaacccggggggtggcggaggcccccagctcaccgtgccccccaacctgctaccgcagacgctgcttaacggcccggccagcgctgcggtactccccccaccccctccccacgccctgggcagccgtgggcccccgacgcctgctcccccaggggctcctgggggccccgcttgtctcgggggtaccccgggtgtatcggccacgtcgtcctccgcgtcgtcttcgacctcttcgtcggtggcagaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttgccaaggccagtgttgctgcctaaaaaaaaaaaaaaaaaaaaaaaaaaaaaatgctataaaatggtgaaagcttccttctaaactgccccaagtgttgaagtcttcactttattttgttctgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaaaaaaaaaa

SEQ ID NO: 331076 - DNA, 2355 bp, Homo sapiens
tcagggccggaatcgggtggtggtgtggtgtggtatcatgcctgtatccagcactttggatcactggaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttgccaaggccagtgttgctgcctaaaaaaaaaaaaaaaaaaaaaaaaaaaaaatgctataaaatggtgaaagcttccttctaaactgccccaagtgttgaagtcttcactttattttgttctgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaaaaaaaaaa

SEQ ID NO: 331077 - DNA, 2927 bp, Homo sapiens
tggtgtggtgcggcgaacctggcttacgcgttttcctgagccggcagatagtagtcctcctgtagtgcaccccgcttggctccacattgctcccgggctcagcgtgacaccacgcgtatggggacggagcccgagccccgagtagggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgccgcgcaacagcaacagcaacagcagcagcagcagcagcagcaacagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttgccaaggccagtgttgctgcctaaaaaaaaaaaaaaaaaaaaaaaaaaaaaatgctataaaatggtgaaagcttccttctaaactgccccaagtgttgaagtcttcactttattttgttctgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaaaaaaaaaa

SEQ ID NO: 331078 - DNA, 4003 bp, Homo sapiens
tggtgtggtgcggcgaacctggcttacgcgttttcctgagccggcagatagtagtcctcctgtagtgcaccccgcttggctccacattgctcccgggctcagcgtgacaccacgcgtatggggacggagcccgagccccgagtagggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgccgcgcaacagcaacagcaacagcagcagcagcagcagcagcaacagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggagggacccccagagctgaaccgtcagagccccaattcttcttcagcggcggcgtcggtggcgtctcggcgtggaacgcacggtgggctggttacggggctgcccaacccggggggtggcggaggcccccagctcaccgtgccccccaacctgctaccgcagacgctgcttaacggcccggccagcgctgcggtactccccccaccccctccccacgccctgggcagccgtgggcccccgacgcctgctcccccaggggctcctgggggccccgcttgtctcgggggtaccccgggtgtatcggccacgtcgtcctccgcgtcgtcttcgacctcttcgtcggtggcagaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagactttttttttttttttttttttttttttttttttttttttttttttttttttttttttttttttttttt

SEQ ID NO: 331079 - DNA, 4411 bp, Homo sapiens
ggttcttaaatgcgtttttacttgggaatgccgggcagggaaaggaaaggtcatcgtctgtttaatttccacccccagctctggacttccagcattagctcgccgggcctcagctgttgtacacacacggcgaggggggaggggagggcggaggcgcggaggaggggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgccgcgcaacagcaacagcaacagcagcagcagcagcagcagcaacagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggagggacccccagagctgaaccgtcagagccccaattcttcttcagcggcggcgtcggtggcgtctcggcgtggaacgcacggtgggctggttacggggctgcccaacccggggggtggcggaggcccccagctcaccgtgccccccaacctgctaccgcagacgctgcttaacggcccggccagcgctgcggtactccccccaccccctccccacgccctgggcagccgtgggcccccgacgcctgctcccccaggggctcctgggggccccgcttgtctcgggggtaccccgggtgtatcggccacgtcgtcctccgcgtcgtcttcgacctcttcgtcggtggcagaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttgccaaggccagtgttgctgcctaaaaaaaaaaaaaaaaaaaaaaaaaaaaaatgctataaaatggtgaaagcttccttctaaactgccccaagtgttgaagtcttcactttattttgttctgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaaaaaaaaaa

SEQ ID NO: 331080 - DNA, 4342 bp, Homo sapiens
  misc_feature (4147)..(4147): n is a, c, g, or t
  misc_feature (4150)..(4150): n is a, c, g, or t
  misc_feature (4154)..(4154): n is a, c, g, or t
  misc_feature (4157)..(4157): n is a, c, g, or t
  misc_feature (4194)..(4194): n is a, c, g, or t
  misc_feature (4198)..(4198): n is a, c, g, or t
  misc_feature (4277)..(4277): n is a, c, g, or t
  misc_feature (4301)..(4301): n is a, c, g, or t
tggtgtggtgcggcgaacctggcttacgcgttttcctgagccggcagatagtagtcctcctgtagtgcaccccgcttggctccacattgctcccgggctcagcgtgacaccacgcgtatggggacggagcccgagccccgagtagggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgccgcgcaacagcaacagcaacagcagcagcagcagcagcagcaacagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggagggacccccagagctgaaccgtcagagccccaattcttcttcagcggcggcgtcggtggcgtctcggcgtggaacgcacggtgggctggttacggggctgcccaacccggggggtggcggaggcccccagctcaccgtgccccccaacctgctaccgcagacgctgcttaacggcccggccagcgctgcggtactccccccaccccctccccacgccctgggcagccgtgggcccccgacgcctgctcccccaggggctcctgggggccccgcttgtctcgggggtaccccgggtgtatcggccacgtcgtcctccgcgtcgtcttcgacctcttcgtcggtggcagaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttgccaaggccagtgttgctgcctaaaaaaaaaaaaaaaaaaaaaaaaaaaaaatgctataaaatggtgaaagcttccttctaaactgccccaagtgttgaagtcttcactttattttgttctgttttgttttgtttttctgttttgtttgcaaaatggtaagggggtgtcgggggggatggggtgtatttnctncccnccntcccctgccccccggtttctctccccccttctccccncccntcccctccccccccctctccctctctccttccctcccccccccacctcccccccccttctcttctctctcccccttctnccccctcccctctcccccctttcncccctcccccttccccccctcccccccctctcccccccccc

SEQ ID NO: 331081 - DNA, 1495 bp, Homo sapiens
tggtgtggtgcggcgaacctggcttacgcgttttcctgagccggcagatagtagtcctcctgtagtgcaccccgcttggctccacattgctcccgggctcagcgtgacaccacgcgtatggggacggagcccgagccccgagtagggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgccgtcggggtcaagacagtggccctgtcggctaaggaagcggcggcggcggc

SEQ ID NO: 331082 - DNA, 2714 bp, Homo sapiens
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatacttttttt

SEQ ID NO: 331083 - DNA, 402 bp, Homo sapiens
  misc_feature (385)..(386): n is a, c, g, or t
cctcgcgaacgtgttatcccatccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttcgcgagggtaccnnctcgattctatctgtc

SEQ ID NO: 331084 - DNA, 568 bp, Homo sapiens
gtttcagagtgttttaggtatccactttctctaaggaagtgcttagttatatttttctcttgcagattgattataccggaacagagccttccagtccctgtaataaatgtttatctccggatgtgacaccttgcttttgtaccattaacttcacactggaaaagtcatttgaggtctgtgtttccaagtaatgtgctagaaaagccatgctttaaaaaatactgatactgtactaaatgtcttttacaaggtattttccttttatagagaagtctgtataatttactggagtttataggcttttgaggaagatcgttttgtgtgtttggctgttggattttgctgtctggtaattaaatacatttatttgaatggtttagttagtactttgtagacaaaatttaagatattgtattttatcctttcaacagataatgttatgactgtacgaatcaattttttatcaagttttatatacttgtatttttaaaattattgctcaaattgttgtgcatacttacgatactaaagcaagctttactttagaaaataaataattctcccatta

SEQ ID NO: 331085 - DNA, 4503 bp, Homo sapiens
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331086 - DNA, 6410 bp, Homo sapiens
  misc_feature (2783)..(2783): n is a, c, g, or t
  misc_feature (2794)..(2794): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331087 - DNA, 4395 bp, Homo sapiens
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331088 - DNA, 6356 bp, Homo sapiens
  misc_feature (2783)..(2783): n is a, c, g, or t
  misc_feature (2794)..(2794): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331089 - DNA, 5656 bp, Homo sapiens
  misc_feature (2029)..(2029): n is a, c, g, or t
  misc_feature (2040)..(2040): n is a, c, g, or t
taatgtctttctttgcttgtgtttagatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331090 - DNA, 2645 bp, Homo sapiens
  misc_feature (35)..(35): n is a, c, g, or t
atcgagctcggcaccctgattgcatttagactgantgcatttagacaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331091 - DNA, 5879 bp, Homo sapiens
  misc_feature (2783)..(2783): n is a, c, g, or t
  misc_feature (2794)..(2794): n is a, c, g, or t
  misc_feature (5862)..(5863): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggatagttcgcgagggtaccnnctcgattctatctgtc

SEQ ID NO: 331092 - DNA, 5631 bp, Homo sapiens
  misc_feature (2783)..(2783): n is a, c, g, or t
  misc_feature (2794)..(2794): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataagtgaatatccgttgttatattctagtaagttctttttaaccttaatttattaaatatatattggttagatgcg

SEQ ID NO: 331093 - DNA, 1650 bp, Homo sapiens
  misc_feature (1248)..(1248): n is a, c, g, or t
  misc_feature (1250)..(1251): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccagaaaaaaaanannaaaaaaaaaaggggggggggcgaatgatacaataacattatcggcagagggagaggacacaactaaaggccgccaaccccccgcaccttcttttatgatatgcaagacggtgcatactagatatgagacgtgactttattaatatcaataaaggcgcggaggagagtgactacaacaacacgccggcgaagcggaaaacagcgaaccgggccaggacaactgagcgagaaaaaaccccacgtcgaggcgggggcaaaagagagagggcacacccacgaccaagacccaacccacgcacgacacccaaacacagagcacggcgtgaacgacacaacacaccacaacaccgggcgcgaccaacaccacccgccgaccgacaccacgaaaacccaccggcca

SEQ ID NO: 331094 - DNA, 3814 bp, Homo sapiens
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaa

SEQ ID NO: 331095 - DNA, 4092 bp, Homo sapiens
gtttcagagtgttttaggtatccactttctctaaggaagtgcttagttatatttttctcttgcagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331096 - DNA, 4453 bp, Homo sapiens
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataatctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 331097 - DNA, 6220 bp, Homo sapiens
  misc_feature (2783)..(2783): n is a, c, g, or t
  misc_feature (2794)..(2794): n is a, c, g, or t
  misc_feature (5818)..(5818): n is a, c, g, or t
  misc_feature (5820)..(5821): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanannaaaaaaaaaaggggggggggcgaatgatacaataacattatcggcagagggagaggacacaactaaaggccgccaaccccccgcaccttcttttatgatatgcaagacggtgcatactagatatgagacgtgactttattaatatcaataaaggcgcggaggagagtgactacaacaacacgccggcgaagcggaaaacagcgaaccgggccaggacaactgagcgagaaaaaaccccacgtcgaggcgggggcaaaagagagagggcacacccacgaccaagacccaacccacgcacgacacccaaacacagagcacggcgtgaacgacacaacacaccacaacaccgggcgcgaccaacaccacccgccgaccgacaccacgaaaacccaccggcca

SEQ ID NO: 331098 - DNA, 4729 bp, Homo sapiens
  misc_feature (2783)..(2783): n is a, c, g, or t
  misc_feature (2794)..(2794): n is a, c, g, or t
ctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcaccngagaaactacntaacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatacttttttt

SEQ ID NO: 331099 - DNA, 237 bp, Homo sapiens
tgatggtgccgtacatatcagaacttcttttttatggctaagtattccattgtatggctatgccacaatctgtttacttagtcatatgtccacagctacttgagatgtttatagtttttagctatttttgaataaggctgctatgaatacttatgtacatttctttgtgtggacatgtattttgatttttcttaggtaaatacccaggcgtgggatggagggtcatatggtaaatat

SEQ ID NO: 331100 - DNA, 117 bp, Homo sapiens
tccagtgtggacagggaagggagaaagtgctgtggaagaaagaaaatgactggagcaggatctcagagaggcttgtgccaaagttgggtacccaagacccagctggtatctgtcaga

SEQ ID NO: 331101 - DNA, 330 bp, Homo sapiens
ctggaattcaggagtcactatgtgggacactgtgagccggtagaatattctaaaactcagaaatacatattaatcctcagaaattagaaatttcttttccaagtttttcattttccatttcttggactatttgctgttacaatctgtgtttactataatctttccaaattaaatattagttttgtctctgttctacttatttgatttattcagtcattccctcccacttttcaattattcagcctgttaaaagtacaactgtttcttttctggaaaaaataagccaaagctagaaattgttcaagcaggagattttgtttgtggagtgaa

SEQ ID NO: 331102 - DNA, 310 bp, Homo sapiens
gggcaaggaaaggataacatagcaggtccttctagtgcatctgagaaggttcatcttaaggacttttctggtgatgaccagaagctgggggccagagcagaaaagcacaaggggttccccaggaaagaggatcactcagatggctgtggtaaggagccagggtgtgagagagggtgacccttgggctcaggctgggtgtgttacctgggtccagggagaggcaggtgcccaggaaaagatgggtggtccagggacaggcctgctgcctatgggagcaggtgagggatgcgtgaattctcctggtcccacg

SEQ ID NO: 331103 - DNA, 293 bp, Homo sapiens
tgcatattattcccagcagctgcaaaaggcaagcccagccctcctggaatcagcagtcctgcccaaagttataatttggccatgggtaagattcaagcccgctaacctgttggaatgcagctgtcaggaggtgatggacaggaagaggaggcggccagcttcctcatggttccagcagagaactggcctaaaaaacgaggaaagcttctgggactctttgctctgagtagaaagggatttaatagtgctttccctacttgtgtgtagaggtgggcaacagccagtgccttgca

SEQ ID NO: 331104 - DNA, 384 bp, Homo sapiens
actggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttt

SEQ ID NO: 331105 - DNA, 171 bp, Homo sapiens
ccgggctagagccgactgactgcaagtgaggggcaggccctcagagaggagacttccctgcggagcccactctgctggtttctgtgtgcttcatttggctctttgcttctgcagataacctagacccactgacgctgcgacctaacactccgcttcctatgctgccctgtc

SEQ ID NO: 331106 - DNA, 279 bp, Homo sapiens
caactatcttgtgcgtcttataatggatgtgaatattctccattagctgccttggcaactactgatgcctccttgaaaaaatattgaacttgtaaacagattccatttaatagatagatgggtttcattataggaattgaggatatcagcactaagctagttagtaaccttagtaaatgatgagacttggtgttaggctgggtaagaggagatatcaccttatgtctctgtaataaattctagagaagctatgtatttttcacctctatcacatgcttg

SEQ ID NO: 331107 - DNA, 132 bp, Homo sapiens
acaaaacatagcatttcactacaaaatgaactctctccagggaccccaataccacctgtaatttagatgaaaaggcccaaagagaaggcttttctttcatggcttaaaccctggcccattctatcactaata

SEQ ID NO: 331108 - DNA, 453 bp, Homo sapiens
aaatggacttgggcaaccctatcaaaatcaactggccataggtgtgtgggtttatttctgaactatcaattttattctattggtcaacatatttatccttatgccagtatgacactgttttgataatgtggttttgtattaagttttgaagttaggaattgtgagtccttccgctttgttcttcattttcaaggttattttgactattcagggccccttgcaatttaatatgaagttgaggattgagttttccacttctgccaaaaaaaggctgttggaattttgatagggattgcattgaatctgtagataactttgggtagtattgacaccttaaatatattgtcttcctactcatgacttaataagggatgtttttccatttatttaggtcttctttgattttttcagcaatgttttgtagttttcagtgtacaaaactttcacatgttt

SEQ ID NO: 331109 - DNA, 1775 bp, Homo sapiens
ttctatgaggccagtcaccctagttttgattctggaaagaacgtgtgtaggtcaaaaggagttggctgatcaaacgttcttattttcccccttgaattctgacatcctgattctgaatttctccaacagtaatccataagatgctatatttctgaagtattggcctgattgagcacatcaaaattccatttctttccgtttctcatctggtgttttcagacataactaacactgaggaatagaatggaagtagagtataagacacttttgaaagcttgtattttcatatactctatttggttctgttgtaacagattagctccagggtttataatcccaacctatagactgtttatacaggtttttaatcccacctatcctgttgtttgttctgtagcacataacacctcctaacatcatctctaatgttgtgctttattatgtatgttatatatagatttgtctcagattagaatgtgaattccccaagggcagagagttctttgtattttgctcacggatacatccaaaagcctaaaatggtgtcttggcatgtaatagaagtttaaagtgttccataaatgataaatgaatgaaggaatagttgccatccaggtgaatctaaaataaaggctgttaccttgctaccttctcacctaatactattttccctcttctcttgagggagaaacaaactgttgctacaaatctcactcttcaggagatatatcccccccatttactctttgtcaaagcttaacagtgtcaacaccatttgcataatatagtaattattgtctaaacaagaacaaatatatacattagtaggtgaattttcagttgcacaatcttttagtttgcataactaaggaatatgaaaatatctttagtctaggcgtagtgtctcgtgcctataatctcagaactgtgggaggccgaagcagatggatcacttgagcctaggagtttgagactgtcttggggcagtgcagaccctgtttctattttaaaaaaataaataaaatggcctggtatggtggcatgtgcctgtggtcccagctgcttgagaggctgaggtgggaagattgcttgagcctgagagtttgaggctgcagtgaactatgatcacgccactgtactccaggctgggagacagtgagatacttaaaaaaaagaaaaagtatcttcaaaaatgttctgacgtaatctgtgctgcctagcattttgttctccaagctgagtggaataatgcctttcatttacatgttaaatggaagcctatttttaggctaaatgtaagtcttaaagtactgagcagaaatatcttccacatcctattgttgcattaaatccctactgatattttaatggtaattgtgatagtacctgaataactattgtgtaagaataaagttaatgtaaaaaaatttttaagtgtgtagtcttactgagtacatttgcttttcatggtatcttttctctgtttatattcaagttttatgagcaatatgatgatgatgaaattggagctctggataatgcagaattggaaggttctattcaagtggacagcaatcgcttacaggaagttttgaatgactactataaagagaaggcagagaagtatagtgacttttccttccttgtttagctgttcttttttttaaaaaagaaaaaattccaaagaaaggtctatagtataactgaattgaggaaaaaattaacctagtcaaaatacatattgagaaaatgaaaaaggaaaaaagaaaagggga

SEQ ID NO: 331110 - DNA, 743 bp, Homo sapiens
gtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaagaaagctgtgtcttttcacttggtccaccggagccaacgagatcctttagcagcagatgagagtgcaccccagagggttctattgcccacacaaaaaatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagaagaaacgctagtaattccaagcactggaattaagttgccttcatcagtgtttgcttcagagtttgaggaagatgttggattgttaaataaagcagctccagtttcaggacctcgactggattttgatcctgacattgttgcagctcttgatgatgattttgactttgatgatccagataatctgcttgaggatgactttattcttcaggccaataaggcaacaggagaggaagagggaatggatatacagtatgtgtggtttgtttcaaagcagagatgatgacctaagtgttactgcttcagtgggatggtaaccatagaacgttacagttggaagagacctt

SEQ ID NO: 331111 - DNA, 396 bp, Homo sapiens
gtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaagaaagctgtgtcttttcacttggtccaccggagccaacgagatcctttagcagcagatgagagtgcaccccagagggttctattgcccacacaaaaagtaggtcctgttctttagccagtcagtttgtaggtagacaatagttttttttttctttttttttttttaaataaatagagtcttagcacgttgcccaggctggtctcgaactcctggacttaagcagtcctcccagcttggcctccaaaagt

SEQ ID NO: 331112 - DNA, 2422 bp, Homo sapiens
ttctatgaggccagtcaccctagttttgattctggaaagaacgtgtgtaggtcaaaaggagttggctgatcaaacgttcttattttcccccttgaattctgacatcctgattctgaatttctccaacagtaatccataagatgctatatttctgaagtattggcctgattgagcacatcaaaattccatttctttccgtttctcatctggtgttttcagacataactaacactgaggaatagaatggaagtagagtataagacacttttgaaagcttgtattttcatatactctatttggttctgttgtaacagattagctccagggtttataatcccaacctatagactgtttatacaggtttttaatcccacctatcctgttgtttgttctgtagcacataacacctcctaacatcatctctaatgttgtgctttattatgtatgttatatatagatttgtctcagattagaatgtgaattccccaagggcagagagttctttgtattttgctcacggatacatccaaaagcctaaaatggtgtcttggcatgtaatagaagtttaaagtgttccataaatgataaatgaatgaaggaatagttgccatccaggtgaatctaaaataaaggctgttaccttgctaccttctcacctaatactattttccctcttctcttgagggagaaacaaactgttgctacaaatctcactcttcaggagatatatcccccccatttactctttgtcaaagcttaacagtgtcaacaccatttgcataatatagtaattattgtctaaacaagaacaaatatatacattagtaggtgaattttcagttgcacaatcttttagtttgcataactaaggaatatgaaaatatctttagtctaggcgtagtgtctcgtgcctataatctcagaactgtgggaggccgaagcagatggatcacttgagcctaggagtttgagactgtcttggggcagtgcagaccctgtttctattttaaaaaaataaataaaatggcctggtatggtggcatgtgcctgtggtcccagctgcttgagaggctgaggtgggaagattgcttgagcctgagagtttgaggctgcagtgaactatgatcacgccactgtactccaggctgggagacagtgagatacttaaaaaaaagaaaaagtatcttcaaaaatgttctgacgtaatctgtgctgcctagcattttgttctccaagctgagtggaataatgcctttcatttacatgttaaatggaagcctatttttaggctaaatgtaagtcttaaagtactgagcagaaatatcttccacatcctattgttgcattaaatccctactgatattttaatggtaattgtgatagtacctgaataactattgtgtaagaataaagttaatgtaaaaaaatttttaagtgtgtagtcttactgagtacatttgcttttcatggtatcttttctctgtttatattcaagttttatgagcaatatgatgatgatgaaattggagctctggataatgcagaattggaaggttctattcaagtggacagcaatcgcttacaggaagttttgaatgactactataaagagaaggcagagaattgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctgccaaccatcttgtaaatattgtaatactttaatttttaatattataagcttacatttgctctgaagtaaatgacttcatgaatgtgaaatgtttgataaattaaaggaaaatatcttcataacgtgaaaaaaaattg

SEQ ID NO: 331113 - DNA, 827 bp, Homo sapiens
tcttcacttttaaaaactcgtctaaaagttgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctgccaaccatcttgtaaatattgtaatactttaatttttaatattataagcttacatttgctctgaagtaaatgacttcatgaatgtgaaatgtttgataaattaaaggaaaatatcttcataacgtgaaaaaaaattg

SEQ ID NO: 331114 - DNA, 277 bp, Homo sapiens
caagacctgccaatgaatgagcttgatgagtctgaggaggaagaaatgattactgtagtccttgaagaagccaaagagaagtgggattgtgaatctatttgtagtaagtatattcactttatgatagtaattttaaagtattaaagtatatcaactttaggctgggtgcggtgcctcacgcctgtagtaatcccagcactttgggaggccgaggcgggtgggtcacctgatgtcaggagttcaagaccagcctggccaacatggtgaaaccccgtgt

SEQ ID NO: 331115 - DNA, 400 bp, Homo sapiens
tctttgtctttttcccatcagccaaaatgttcatgtgccatctgcctcctacttggaaagctgtactcattgtaatattcccatgccttatccttggaaggcttactgattccattttgtttatagatagtgaagaaagtactaattccatttcgtttatagatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagaagaaacgctagtaattccagtaaggcttttcagcaatttaattgtgggagtgaggtgaagaaatcatttttgaatcaagatat

SEQ ID NO: 331116 - DNA, 1831 bp, Homo sapiens
gtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaagaaagctgtgtcttttcacttggtccaccggagccaacgagatcctttagcagcagatgagagtgcaccccagagggttctattgcccacacaaaaaatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagaagaaacgctagtaattccaagcactggaattaagttgccttcatcagtgtttgcttcagagtttgaggaagatgttggattgttaaataaagcagctccagtttcaggacctcgactggattttgatcctgacattgttgcagctcttgatgatgattttgactttgatgatccagataatctgcttgaggatgactttattcttcaggccaataaggcaacaggagaggaagagggaatggatatacagaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtggacagcaatcgcttacaggaagttttgaatgactactataaagagaaggcagagaattgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctgccaaccatcttgtaaatattgtaatactttaatttttaatattataagcttacatttgctctgaagtaaatgacttcatgaatgtgaaatgtttgataaattaaaggaaaatatcttcataacgtgaaaaaaaattg

SEQ ID NO: 331117 - DNA, 1393 bp, Homo sapiens
agagcatttaatctgagacttctgtattttagagcagaaaatgtgagattcattgcttttcctaccaaaccagattgatcaaacaccctcactcttcctgcctagacaagaacccttcctgaaataccttccaattttacttgtgtaaagtggttttgttctgttactttttaagttgttttggtaggtaatttatgacctttactttaggaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtggacagcaatcgcttacaggaagttttgaatgactactataaagagaaggcagagaattgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctgccaaccatcttgtaaatattgtaatactttaatttttaatattataagcttacatttgctctgaagtaaatgacttcatgaatgtgaaatgtttgataaattaaaggaaaatatcttcataacgtgaaaaaaaattg

SEQ ID NO: 331118 - DNA, 444 bp, Homo sapiens
ctaaacacagtccgtattcctacataggaattattttgtgtaattttcctttctaataaaaattttattttatttatttatttttcagacgggttcttgctgtgttgcccaggctggagtgtagtggcatgatcatagctcactgcagcctcaaccttctgggctagagtgatcctcttgcctcagcctcccaactagctgggactacaggtgcacaccactatgcctggataatttttttattttatttaattaatttatttatttctgagacggagtctcgctctgttgcctaggctggagtgcagtggcatgatctcggctcactgcaaccttcgcctcccgagttcaagcaattctcctgtctcagcctcccgagtagctgggactgcaggcacccaccaccacacctggctaacttttgtatttttagtagagacgggg

SEQ ID NO: 331119 - DNA, 388 bp, Homo sapiens
tcactacaacctccgcctcctgggttcaagtgattctcctgcctcagcctcccaagtagctgggattataggcatgtgccaccacacccacctaatttttggtatttttagtagaaactgggtttcaccacattggccagactggtcttaaactactaacctcaggtgatctgtccgcctcagcctcccaaaatgctgggattacagatgtgagccactgtgcccagcctctttttttagtgtatttaaggtaattgattgaaagtttttgtctagtcattcaaatgtctaggcttcctcaggaacagtttctattaatttctttatttttaaaaaattttttttaattttcttttttttttagatggagtctcactctatagcctag

SEQ ID NO: 331120 - DNA, 675 bp, Homo sapiens
cggggagggatgggtgaagaagctggagctgccaacatctagtttattccttttacttaaactagaggcattaaaaaaaaaaaggtccaaatattttgggcctctgccaccaaaccacaggcagttctctggtctgcactggagtttggatgactgacaagactcagtgaaaaacaagtgctatttgttttcctgtgcctagtatttaactggaaatcagaaggctaaatttccaatcagttgctaaatagccccagatgtgtgctcagtgcagcactaggaagggacacgcacagcccataccaccgtgcatgtccagctgttaccttttcatgaagccaagtgatgtgtaactgagggttgtagtgtctgtccaaaaacgccctaagaataactcagacattcaagtttgcttgtggagaagggaactttttttaaaaaaaattctgtattctattgtgttacatttaaaaatctggaaataatttttttctttgctaatttccttctttcccttctttggcagttcccccacccccatgtttagaaaaaaacacagaattagcataccgggtatgatggtttatgtatgtgcttgttcattcatccaacacacagtttttagtgcctgactgtgaactgtgctagctgtggaggatctagggaaaactgggg

SEQ ID NO: 331121 - DNA, 300 bp, Homo sapiens
taccctcctgatctttcccctgaaacctgctttgcctacagtactgtccatctccgtttggaacaatgccatccttctgggcagtaaaaccgaaaaaatctgaaagccacctttggttcctttctgttccatcaacatatccttcaaaatctattcaggaactaaacacttattgccacttctccaaacaaccaccatccctcatctaactatctaaattactcaccagcctcttcacgggtttccctgcctctgccctggttcccctttaatgtattttcagtgcaaagaccagagtga

SEQ ID NO: 331122 - DNA, 489 bp, Homo sapiens
gctgaggcaggaagatcactttaatcctggaggagaaggttgcagtgagctgaaatctcaccactgcactccagcctgagcgacacagcaagactctctctcaaaaaaaaaacaaaaaacaaacaaacaaaaaaaacccaggactagttcatcaagaagcaaaataatatgacaaaccctacttaaatgatttcatctggtttcaaccactgccagctggtttgatccagtttcagctggtttcaaatgacttcatccagtttcagccaggttaattcagcttcagctggttgtgaacagtttgtggctcctttcaaccagtttcaggtggtttcagccaaggtcatccaatgttggctggctccaactgatttaactcctgtttcaactggattcagctgatttccactctccttaaggctgtgctgtccaattcagtagctcctagctacatgcagctctttacatttaaattgattaaaattaaag

SEQ ID NO: 331123 - DNA, 264 bp, Homo sapiens
ctcaatcgatcagcccacctcagcttcccaaagagctaggattagaggtgtgagccacagcccctggcctttaatcgaattttaaagtaagcattgcttaaaacatgtcactcatcaacagcagaacattcagaatacctagggcagcagttttcaaattgtgggctgagaaccttgggattctgagactttgtcagagaataaataccctctacttactgaaaagggaatttttaaaacctagcaccacaggaatctctttta

SEQ ID NO: 331124 - DNA, 168 bp, Homo sapiens
catggtggcaggtccagagccacctgtggtgaccagcaccaacagtgcagtaggtgaaacagagttagttactgggaacaaaagcaatactaatggaaacagccttcccatgagtataaggagctggactagtctcccttgttctaatggacatcctccttacgtgga

SEQ ID NO: 331125 - DNA, 219 bp, Homo sapiens
gaagacggtggggccaggccacgtggagcccagcatgggttctgcctttctctggaatgatttttaagcagaaatgtgccaacatccaatttacaatttcaaaagcttgcccgtctgtgggagagtgaggaaataaaactaaggcgccaatgtggatgggaatggtagcaggaaatgatcatgagcctacaattattcactatctactttgtgcagaga

SEQ ID NO: 331126 - DNA, 422 bp, Homo sapiens
gttgtggaatcataggtagggtgctggataataacaagggttggagaagaaagaagttttccctaaaagacacttggcagatgacttgccaacataaagaacttagttctgttatctaagatctatctggatgttttctttacccatgtttgttggggttttttgtttttgagacagggtcttgctctgttgaaggggtgggttgcccctccacacctgtgggtgtttcttgttaggtgaaacgagagacttagaaaagaaaaagacacaaagtatagagaaagaaataaggggactcaggggaccagcgttcagtatacggaggatccggccggcttctgaggtcccttagtatttattggtcattcttgggtgtttctcggagagggggatgtggcagggtcataggataatagtggaga

SEQ ID NO: 331127 - DNA, 500 bp, Homo sapiens
ctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtga

SEQ ID NO: 331128 - DNA, 603 bp, Homo sapiens
caatttctctcagaagtctgatagccaaagaaatgtctcaagatttcagtcaaatacacacatggcatgcacacacccataaacacacacacaaagaaacaggctaaaaagaaagtgatagcaactgcatcattaaaggccatcgtgtatcctgttaatctcatcttttctgctacttctttcattccaatagcgatggcagacttttttcagggggaataattactcttcgggatatataaatggagcagaaaggtggcgggcaaatttaaacaactggaattgggggccaggttcttcaggggaaaggaagtttgaagaagctttcaccaaaagaaaaaaatatagaaggggcttatctaacaatcagaatagcctgcaatatgagaactagaggattatttcctttaaaaaaaataacttaaaagatctgtgggccacaataacctaataagcaaggacatgttgggatgtgaggacggctgtgcaggtgagcacttggcagctgccactggtgttttcacccaggtacaggcagacggtgttccattaaaggagcaggcaaaagagagctgtcaatttgcttgctgttgaaatgtacat

SEQ ID NO: 331129 - DNA, 388 bp, Homo sapiens
tttgaaaaataaagtaggagggctggatgaataaaaaactagtatagaggatataccccacgatgaacttttgcgtttaactatagattgactagaaataatttctgaggccgggcgcgatggctcacgcctgtaatcccagcactttgggaggccaaggcgggcggatcacgaggtcaggagttcgagaccagcctgaccaacatgatgaaaccccgtctctactaaaaatgcaaaaattagccgggcgtggtgacgcacgcctgtaatcccagctactcaggaggctgaggcaggagaatcacttgaaccagggaggcagaggttgcagtgagctgagctcacactactgcattctagcctgggcgacagagcgagactctgtctc

SEQ ID NO: 331130 - DNA, 1002 bp, Homo sapiens
aggtgcaaataagggtttggtggctcctcccaacctttctccaggacagcctgggagactggactgctgggagggtctagggtcaaaagcatgtcccaaagggtgtatcctaattctccaagtgagacagtgactgccccttaatcctgccagcctcgagggccacatggctttggcctcacttggccttaggatttgtctgcagagaagagaaaatccaggtagctgtggttccaatgaggtggtggtttattttctctcaggtagaagaatttcagaggctggtggtctcggctggaatgggtggctccacaaagtcatcaggcacccagctttcttctgtcactcttcttcgtcatccttagcacagaccttctatctttaaagaagcctcatgattcaagatagctgctacagtgccagccatcgtgtcatgttttaggcaggcagagagagaggatgaagggcgaaaggacgcgtcttctagctgagttggtcctttaagatctttcctggaagcttcatccaagggcttctacatacctctctgtgaccattctgtctgcaagagatagagaatcataaagtcttttatctgaggaatttgctgcccagatggaatcagggttattttggaaagaaagaagggcagaatcgcttgttgggcaggcaacctgctgtctgtcctacaggtctcaacttgtcacactctcgggccatttggctctgcctctgggagggaggagactgggttggggaagagtcacagtggaatattcaagttgacctcacagcaaaggtgttggatgaagacagaatgtagatatctgaaaatagatcctgacatgccctcaggattcaggtgtctgacacagaaaaattatttttcgtttgttcctgtgtccaaggctggaagtgtggttacggctctgttcccaagtctgggtcctctaattgaacacgaggaaggttccactctcaaaggctctggccggcggccgc

SEQ ID NO: 331131 - DNA, 1247 bp, Homo sapiens
cctcaggtgatccacccgccttggcctcccgaagtgctgagattacaagtgtgagccactgcacccggcctagaattggcatttctaacaagcttttgggtgggtcttatgcacagctggccccgggagcccctgggctggggacgggttgtgggagcccagcttagcccacaattaggtggggtttctccccagtgaggccccaggctttgccaggctgccggtagcctggtgggcacttggctttgcccccacggcagctctggagcctcaccaagcctccagggcccaccctcctgcccagctctgtgtctggcacctgtgcctccttccttcacacccactttggtgaccctcacggctgcttgtccccttgaggtactgacactcacttcccagggagggtgcccaaccttctgccctaattgagggcagggctatccccgctcaagcaggacactggaatgaaagaactgtggcccattttgctaggattgtttttgctgttatatgggttggtattttcaggaattttcaaggacggggacagaggtcatctttctttatcctgagattctactgatacgctcaacttgcaaaagagtcattgtgagtgtgtgacagtccttttgtgtggatccccaaagaaagcaaggtgttgccagttcctttctcctgcaggattttttttttctatcagtgaaatattattaaaatgtcttaacatttgtttagtgccctatattttataaataacacatctttgtgcttttttattgtgtaatgaatcctcacaactctgaggtgggtgggattgacaccagttcacagaggagagtggggaggtgcagactcatgagcagcatacacggcattcttgttgttttctagataccatcgataatggggtgggtgctgtcgccaacatccctcgaggcgtggtgcggtggcaggacttgtccagggtcccgcagctggtccatggcagagagggtttctgaagactgtacggtgcttctcttaccactgtgggggaagttgtgtccagaccacatggctggtctgtggtggccccatccctagaagcatcctaactctaaatctagatctctttccactttggttccgtcctggcccttgcacagctctgggcccacaagagcctgtggttggccggtcctggatttctcgagcagagtggctggggctggcgactcctacgtacgcttttcctctagagacctctg

SEQ ID NO: 331132 - DNA, 1808 bp, Homo sapiens
cggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggtgccttgtggcctctttgtggccaattgtgctcttctgctggcatttcctgttgacgactctcacagcaacagtagacgcttgttaagggccagcggtgcggagaagtgtgccgtcgtcacactatgttaccccacatacagacgtggaaacaggctgggagttaagtaattcgcccaggtcgcacagccagtgaggggtagatggcagtctgagccctctcattgctgtaaaccctgcctgcatgcctgttggtttctatttgtgccctgtactcactcaggaggtcagtgtgcctcgggtgcaccttcccctgggcctgtcccatgcactgtgaggtccctttcagctctggccctcctactgcccaggtagcacacgtagtcccctggatgagccgcgaggctttctgctgtgggtagttctttatcaccgcgggcttttccaccatcatcagtgaactctctgtggcctcgcccaggccttccaacttaggaattttcaaggacggggacagaggtcatctttctttatcctgagattctactgatacgctcaacttgcaaaagagtcattgtgagtgtgtgacagtccttttgtgtggatccccaaagaaagcaaggtgttgccagttcctttctcctgcaggattttttttttctatcagtgaaatattattaaaatgtcttaacatttgtttagtgccctatattttataaataacacatctttgtgcttttttattgtgtaatgaatcctcacaactctgaggtgggtgggattgacaccagttcacagaggagagtggggaggtgcagactcatgagcagcatacacggcattcttgttgttttctagataccatcgataatggggtgggtgctgtcgccaacatccctcgaggcgtggtgcggtggcaggacttgtccagggtcccgcagctggtccatggcagagagggtttctgaagactgtacggtgcttctcttaccactgtgggggaagttgtgtccagaccacatggctggtctgtggtggccccatccctagaagcatcctaactctaaatctagatctctttccactttggttccgtcctggcccttgcacagctctgggcccacaagagcctgtggttggccggtcctggatttctcgagcagagtggctggggctggcgactcctacgtacgcttttcctctagagacctctg

SEQ ID NO: 331133 - DNA, 2032 bp, Homo sapiens
cggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcacctgtagaagaatttcagaggctggtggtctcggctggaatgggtggctccacaaagtcatcaggcacccagctttcttctgtcactcttcttcgtcatccttagcacagaccttctatctttaaagaagcctcatgattcaagatagctgctacagtgccagccatcgtgtcatgttttaggcaggcagagagagaggatgaagggcgaaaggacgcgtcttctagctgagttggtcctttaagatctttcctggaagcttcatccaagggcttctacatacctctctgtgaccattctgtctgcaagagatagagaatcataaagtcttttatctgaggaatttgctgcccagatggaatcagggttattttggaaagaaagaagggcagaatcgcttgttgggcaggcaacctgctgtctgtcctacaggtctcaacttgtcacactctcgggccatttggctctgcctctgggagggaggagactgggttggggaagagtcacagtggaatattcaagttgacctcacagcaaaggtgttggatgaagacagaatgtagatatctgaaaatagatcctgacatgccctcaggattcaggtgtctgacacagaaaaattatttttcgtttgttcctgtgtccaaggctggaagtgtggttacggctctgttcccaagtctgggtcctctaattgaacacgaggaaggttccactctcaaaggctctggccggcggccgc

SEQ ID NO: 331134 - DNA, 1367 bp, Homo sapiens
cggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcaccttgttcacgggcagcggggacgcttgcgcccgggccttcgacgcgcagtctggagagctgcggagggtgttccgg

SEQ ID NO: 331135 - DNA, 218 bp, Homo sapiens
tctagtgtatatactgtcatgcaagcaaacaaacattaataatgagcattatccacaaatagcatgtttatcaaattgctagcctcttacaaccctgtgactcataattcaacttaatctgtttttctgtaatgtcaaaataagcccttttaaagcaatatgtattttttaaacaatgccttgtagcttttttttttttttttttttttttttttttt

SEQ ID NO: 331136 - DNA, 1279 bp, Homo sapiens
ttatcagtacaaataaaattataatgaaaagtctatgaagataatttgttctcagatgcccttcacatatagcaattaattcacaaatgatgagtcactcatgtgccttcatgaaggcaggccctcaagagacccgcaacagaaaggaaagccaccgactggagagaacctgcttcctgagccccaccaagttccaaaaaggagaatggggcttcgtcctcaccctcaaggagttgccaaactgggcttggttattattcacacttgaaaagaatgaggaaggtcagccagtcccctccaggtcgctcgggcttcctccaagctcctcttggttcaaatttgctgtgtcctccagccggcatctctcctctgttccgtaactgacagggcagcgaggtagcttccggatgactcctcccgccatggttcttccgtccatcagctcttccttcctcaactctgtggtatgtggctaggggagtttccaactcccaggggacatttcagttccccaaagataacacagctttgcacagtggatgtttacttgctggtggtcttatctaagatcaacattggcagctgtgcccggagaggcctccagggtccaggtaagtggaggcttcatgtctcaggaggtacctggtcaccacagttaggatttttctgtttggggatttttttttttatgggttggtggctctgaaaaagctgcaagtcttctctgaggactacagacctctctccaccctctccacattcagcctctctgggctccagggccaaaagatgtctacactcaggtggcagacaggcctgtgaagacctcctggtgacatgctcatatgttgctgggactaaaggtgggattttagccaccacagtgggttggtggtgagatgtttaccaacaggaggtactttgtccctcatgtccacttaaagattcagtccaacccggcctgtgcttctgctgtcccaagagactctagaaagctccaatcctccctgaggttgatcttttaagtcagggtaggtggtcattcggcaatcaactgctctactgcctcaatgtcctcctcactggacgtcctgccccaattccatcctgttcagcgcagactgattttcctggaacacaatgttcattatggagccagatggcatatcagaaagagcactgtattaggagtcaagagatccatgggggaatcccagcattgcccctgatggctgtatagctttggggaaagtgaggccctcttggcattcagtttttc

SEQ ID NO: 331137 - DNA, 1359 bp, Homo sapiens
ggcacgaggcagccaccgccgcaatcatgggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331138 - DNA, 1187 bp, Homo sapiens
attacaggtggctgctagtttttttgtgtgtatttttagtagagatgagatggggtttcaccagttcaggctggtcgcgaactcctggcctcaggtgatccacccatctcagcctcccaaagtgctgagattacaggcgtgagccaccatgcccgacctagactgattttttttaatgcagcctcctaattttctctccaggggcaaaccttttcagctcttagctatttcttatacagtttacttcagtgtagaaacaacatattgaactgttaccttcctctaccacagtagttttcaaactgcagtgttgttaaacctgttaaaacagattgccagccccacccccagagcttcctaatcagttgttccaggccccaagaatctgcagttgtagcaagctcccaggtgaccgatgctctgctctggtctggggaccacactttgcgaaccctgctccccgccaccccatatcctctcgctgtagctctgtcacagtttgctgaaaacagtatcctgtgttgacatcatcatccacagctgctgttattgttacttctttttttctgtgagtttttattcctggactctcattttggtgagatttcagtggaggagggacatgctctgttcacccacaagcctctgggcagtggttcttgatgaggatgaggctcatatttaggggacagcagagggaagggcacagacccgtgataatctgcttgtgcactgactcgcaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331139 - DNA, 547 bp, Homo sapiens
tgaatgcttactgtagcatgggtgaaggagtgagtgaacaaacaaatgcagtcaagaacttgagatggttgtattctaactgccatgagttaatttaccagtgatatctttggttctaggtgtcagtaattaacactgtggatacctcccatgaggacatgattgtaagtattaatatcaccctccctggaggggtgtggacatgggcatttttgtgggagggaagcaatttggggttttcattacccctttctgttgatcattcatggatccagggtggctttgcagtggttgcctatcagcctgtaatctcggggtatggcaggctccctagcagtgccctctgagttgtcaggactgtggcagtctaatcactctctgctgggaggaacctgggaataatttgtagttctaggctgtcagtcttccagccaacacaataacctgctctcggatgaaggctgagtgggtacggaggcttgacaatagtcttcccacctgtcttcctcctgctgtcactccttcaccccagctaggaaggggggtg

SEQ ID NO: 331140 - DNA, 868 bp, Homo sapiens
agtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacacca

SEQ ID NO: 331141 - DNA, 297 bp, Homo sapiens
gggaaaatgggttagaagttagggcagtggttacttatagtggaagagggagctgtgattaggaagggcataatgacagggcttttcaggcaggtggcagaatttttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtgga

SEQ ID NO: 331142 - DNA, 1331 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331143 - DNA, 1421 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331144 - DNA, 1860 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331145 - DNA, 1599 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatgacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331146 - DNA, 1174 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataagtgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331147 - DNA, 1104 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331148 - DNA, 1125 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331149 - DNA, 1308 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggccgtagggccaaaatttgggggacgccgcctggtcattggaaggggcgagaaacggagtagggaggacgacatgagccagacggggggtcgtgcatacgtaggtaagggggtgagttaaggaggggggagggagggtgaggaggagggtgagggaggggggcacggggggggtgtgggagaagagggggagaggcagaggaagaaccagcaccatggcggctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331150 - DNA, 1081 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggccgtagggccaaaatttgggggacgccgcctggtcattggaaggggcgagaaacggagtagggaggacgacatgagccagacggggggtcgtgcatacgtaggtaagggggtgagttaaggaggggggagggagggtgaggaggagggtgagggaggggggcacggggggggtgtgggagaagagggggagaggcagaggaagaaccagcaccatggcggctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331151 - DNA, 869 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccgtgagtccatcccctgcctttcatgcagtgagagcgcctgccttgccccgtgtctgctgcagcctccctagagggtggcacgggagggtccccgctgggcagtgggccggggagtggtcagctgaccagacatgattgctctagagcagctttgagcctctctgccctgaagccagaccaggcagggcttggcactgcttccttgttgtgtgctcccaagcaggggagggctggtgcagcagcagcctgctcactgccaccttagctatggttgcctccaggtgacatgccctgcagtagtcattgggaccctgtagaatggagtggtgttattaaaacttttaaaaagtatgtgagctatgcatacatttaagaaagattaatata

SEQ ID NO: 331152 - DNA, 1262 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacacca

SEQ ID NO: 331153 - DNA, 159 bp, Homo sapiens
cgtcaaaatctttgatgtgcgcaatggagggcagatccttatcgccgacctcagggggtaagtgctggcgagcccagggaagggctccaggaatggtgtgggttctcaggccctgcttcaagcgtgggagcaaagcatgggagcccagattcagagcaa

SEQ ID NO: 331154 - DNA, 637 bp, Homo sapiens
aagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctga

SEQ ID NO: 331155 - DNA, 1616 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataaaaaaaaaaaaaaaaaaaaaaaaaaaaaaaaaaaagggggggggggaagaaagataacccccgagggggccacgtttacgggggtaccagggtttctggacaagggcgcccaatagggggccgaaaaaagcgaagcaagggcggggttaacaacgccggggggacaccggacgggatctctggagaggactactcgggcggcgaaagggacacaacacagggaatagcgcacgacaaaactcagggaagggacaccggaagctggcgaaattggacggtggtggct

SEQ ID NO: 331156 - DNA, 716 bp, Homo sapiens
tctacgactcatcactgccatttgaacttgtcacaagtttgggacatcaggttatgataaagatagacactagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331157 - DNA, 1600 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331158 - DNA, 1996 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccagggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331159 - DNA, 1962 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331160 - DNA, 1826 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaagctcccagcagagatgattgaactgttgctcggggtagggcccccaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 331161 - DNA, 1327 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcattttataagcaatatgactttatttagttcctttggaaacaaaaccccccaaataatgcctgaacccaaaggtaca

SEQ ID NO: 331162 - DNA, 2050 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggcaggccctcaagagacccgcaacagaaaggaaagccaccgactggagagaacctgcttcctgagccccaccaagttccaaaaaggagaatggggcttcgtcctcaccctcaaggagttgccaaactgggcttggttattattcacacttgaaaagaatgaggaaggtcagccagtcccctccaggtcgctcgggcttcctccaagctcctcttggttcaaatttgctgtgtcctccagccggcatctctcctctgttccgtaactgacagggcagcgaggtagcttccggatgactcctcccgccatggttcttccgtccatcagctcttccttcctcaactctgtggtatgtggctaggggagtttccaactcccaggggacatttcagttccccaaagataacacagctttgcacagtggatgtttacttgctggtggtcttatctaagatcaacattggcagctgtgcccggagaggcctccagggtccaggtaagtggaggcttcatgtctcaggaggtacctggtcaccacagttaggatttttctgtttggggatttttttttttatgggttggtggctctgaaaaagctgcaagtcttctctgaggactacagacctctctccaccctctccacattcagcctctctgggctccagggccaaaagatgtctacactcaggtggcagacaggcctgtgaagacctcctggtgacatgctcatatgttgctgggactaaaggtgggattttagccaccacagtgggttggtggtgagatgtttaccaacaggaggtactttgtccctcatgtccacttaaagattcagtccaacccggcctgtgcttctgctgtcccaagagactctagaaagctccaatcctccctgaggttgatcttttaagtcagggtaggtggtcattcggcaatcaactgctctactgcctcaatgtcctcctcactggacgtcctgccccaattccatcctgttcagcgcagactgattttcctggaacacaatgttcattatggagccagatggcatatcagaaagagcactgtattaggagtcaagagatccatgggggaatcccagcattgcccctgatggctgtatagctttggggaaagtgaggccctcttggcattcagtttttc

SEQ ID NO: 331163 - DNA, 986 bp, Homo sapiens
  misc_feature (860)..(860): n is a, c, g, or t
  misc_feature (863)..(863): n is a, c, g, or t
  misc_feature (865)..(865): n is a, c, g, or t
  misc_feature (867)..(867): n is a, c, g, or t
  misc_feature (875)..(875): n is a, c, g, or t
  misc_feature (883)..(884): n is a, c, g, or t
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaccggngcncngngggcaccnaggccctnnggggcgcttggcgcgggggctcgatacggcggcctatcgaagggccagggaaagggggtccccctggtcttcggaaaagggccccctttgggtccctgtttg

SEQ ID NO: 331164 - DNA, 695 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacatcgcatacggtagccgagctcgaatttac

SEQ ID NO: 331165 - DNA, 585 bp, Homo sapiens
ggccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccactggctgcatgccgtcagctgggccactgctcttgcacctgcgagccatcacacctggtagccatcacacctggtagaccatcacacctgtgagccattacc

SEQ ID NO: 331166 - DNA, 186 bp, Homo sapiens
ggagtaggggacgaacctttcaaactttatgttaactgaggaaacagatgggcaaagaaaaaaatgcaagaaggaaagacaaatggccttccacgaagagccagcagacggaggctgttccgtggagacagcgtgggtggaaactttcatgagcagcgtgtgaggtagggggtgggtggagagcgg

SEQ ID NO: 331167 - DNA, 621 bp, Homo sapiens
aggagctgaacatccttggagcaacacatgacatctagaactctacatggtccaaggtctgtctcacaaggaggactgtgtaattaaagctaactacaaactaagctgattctactgtcagatttggtccaaacctacttttcttttaacaacctggtaaccaagtgccatacaagatacactgaactcaaatctacagagactatcaatccttgaacagcaagttcagagcagttgaatatgacaatagccatgtaggatgtgcctgcttcccctctgccatgattttaagtttcctgaggctcccccagtcatctttcctgtacagcctatggaaccatgagccagttaaacctcttttctttataaaatgccaagtctcagctttaatgctatcaatgagaacaagaatatttggcttatcttcaacatcttcataccatcagataactccaaagttaacacaggatacgtcatccacattgctgccagagcattctctctgaaatgattatctgatcatcatcctctcttcttctccacaagctcaaacactttcagtgactgatttgaaaccagttgtaccgtattattaggaaaggcgccttgatgaaaagatca

SEQ ID NO: 331168 - DNA, 167 bp, Homo sapiens
aagatagagaagctaccgaaactccaagactccgatattttctccatcacctttccctggaatagaaattaggatgaaagattattaattcaaaaaaaagcacaaactcagtggtcccagtttcatttgaatcctattcctggcttagccccacgtgtgcactgttt

SEQ ID NO: 331169 - DNA, 247 bp, Homo sapiens
ccccagtgccaagaacagtgcctggcaagtagcgctattcagtaaacatgggccaaattaaagaactcacagttctcttagaaaaatgggaattcaaaaggagagagttctgaaattggtgacttataacctttctcctgtgggcttggagccatctttctgcctttgcatttcaccctccatgggatcattcttttcccctccctcctgaaagcgactccactgtgacagatacctttcacaagtg

SEQ ID NO: 331170 - DNA, 547 bp, Homo sapiens
atatatcaaactgtttactcagaatagtgtcataacagcaaacgactatctgttcatggaaaggtcaaatttcaagtacgcaaataacctatttctttctcccttctttgctgctgaagtttagcttccttttgtttcacacagtaaatggagttggcatgatttctgtgttgcagggtgcctttctgaatattgtgcaaagtctttgtcctagacagtttgactcaatggaatatcacctttcactcttaacttttcccaaacagaaataaggtcaaacttgttttaagctttgactgaattctgaatacaactggtgcttaggagttaaatgaacttacctgtctaaatggcttgaatgagggccacctgcatgttcagtggtttcaggttatctaccttgatattcatctagtaaacctgtctttgaatgtctttccaaaatgctgggaatcctagggcactgtggcactatgtgtgatgtggggtgacatggctgaggatgtgggccttggagggagtcaggtctcagtggatcctggttcta

SEQ ID NO: 331171 - DNA, 354 bp, Homo sapiens
catgccttgattttctctctaactcttagagaagaattttactaattttcaagattttggaaattgagtgctcaatatatattacttctgtccagctccctacctacttcctggtccagccctctggaccactgacaccttttttgtttggtagcacaacttttgaaaaaatataattttgattatacacgttaaatataatcatatatatacatatatatgtacatatgtatgtctatatacatgtgcacacacacgtgtgtgtatatgatttaacatatattcttcctaaggaaatctacaattctaagaaattctcagatgaacttctacaggttttgtgcaacaggtttg

SEQ ID NO: 331172 - DNA, 248 bp, Homo sapiens
ggaatgtgctcaggaaacatgaacttaaagagatatacatttaaagcacattgtttaaaaatagatttatgttttatcaatattaaaaagcactagaaaaaattatttacccctgaaaaattatgctgtcatggtttgggggcagtatttaatcattaattgattttcatattttagactttaaagccagtcctaagtttataagaatttcataagttaaagcacatacagtgctcagaagggtgtct

SEQ ID NO: 331173 - DNA, 341 bp, Homo sapiens
ttgtgattaatagcagatcaggcaaaatcaggactcatgatgttacagacaagaataaaagaaagctccaggaaaactgtttcacagaaaacacagactaaaccctccaaaatggtgaaatgtgagtcccaaatggggctgaacgtagcaaacaaagcaaaagggggcagtgagtttcaagatcacactacgtcagttgctttggatagtatgactttccctggtactaggatctgaaataaatttctcccataggtcctaataagaaggatgctgtgggccaaacgtggtggctcacacctgtaatcccagcattttgggaggccgaggcgggaagatca

SEQ ID NO: 331174 - DNA, 227 bp, Homo sapiens
caagagatctttgggggccccttctagagctgaggcagcaaagctgcctagaaattgggccccagccaagcagagccactgaggtctggcggcccacattgagcaggcgggggtccgggtccatgtggggaggttaatgcagctgcagtgtgcaggcacaggcagcaggtggcagcgtgaccctcagctgtgccacgttacctgtgagccagcagagcagggagttc

SEQ ID NO: 331175 - DNA, 1459 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331176 - DNA, 149 bp, Homo sapiens
cggcacgaggccgagggtgactacgttgtcttccctagatcaattttcttctggatggcctgtggttgtcccccagcctctgccaccctccacctcctcggtcagccccagccccaggttgataaatctattgattgattgtgatagta

SEQ ID NO: 331177 - DNA, 797 bp, Homo sapiens
  misc_feature (432)..(432): n is a, c, g, or t
  misc_feature (437)..(437): n is a, c, g, or t
ggtaaagcctgggtgccccaggtttggttgggggtgaaggggcagatgctggcctggccagttaagtgacaaggctctcagcgtcaaaagccaaggcccccactgggccagtgccagctccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaaaaaaaaaaaaaaaaaaaaaaaaaaaaaaaaaaaaaaaaaaaaaaaaaaaaaaaaaaaaaaaaaaaagaaaacaaaaaaaanaaaanaaaaaaaaaaggggggggggggggcaaaaatatcctggggacgagagacacccccacgcagacgctgttggttagttgttagagggggcgaggcgcaccacaacagggcggcgcgaaataaacattgaaacgaaggccggcgcggccgaccgaacaacaacagatggcgggagcggaccgacgccagaccggaggcgacggtcagctggaacaacccacatcattgtggcgggcaaacaaggaggaccagccacaccccccagaagggactggcgggcggagaaaacaaccaacgagcggcggtggtagagacccacgcaccacgcgggaggcagagacgggccggagcgcaagaccaac

SEQ ID NO: 331178 - DNA, 747 bp, Homo sapiens
ataggtctacggcctgtatcctgggtatctccaatatttaaaagtcaggactggaaggaacgattgggacggattagccattgacgtagaagaaccaagaggtgtcccaaaagccaagtggagagagtttcaagaagagagagtgagcagttgtatcagaagctactgatagtccagtaaaatgaggagtgagaattgaccattgaaattagcaacaaagagattcctggagactttgaaaggaacaattttgatactgttgaggatgaaaatcggatcaaagagcaaaaaaggaagtggagacattacctataggtgacttgggagtttcactgtaagggagagctgagaaatggagtgggatctgaaggagaaagtggtgagatggtgggtttggtggtgagagcaagtgaagttctgttgcttctcttttcttagtggaaattgaaagcaaggacattagctaagtgaagaaataggagggggttttgggagcctaaggagagaggagaaggtctaagtcaccttagagagtgggagagtgaactgattagagaaatgaagtggaattgccaggcagtcctaaaggagcttcaggaaagaagtaggtacagagagttgaatggaaccagggtgtgggttttgctggatttgtaaatgaaagacgagaggaacagggagttgtggttatgtgcagagtattaccagtgacccttgggcttaagcaccttggggtccgccctgcac

SEQ ID NO: 331179 - DNA, 1176 bp, Homo sapiens
  misc_feature (24)..(24): n is a, c, g, or t
aattcgcggccgcgtcgacacggntgcgagcaagacgacagaagggcacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331180 - DNA, 1423 bp, Homo sapiens
  misc_feature (83)..(83): n is a, c, g, or t
gagctcggtacccaagcttttacgcatcaacctatacatctaaatcttggacttcatgtgtgtctacccacagtgcccatggnctatctacttacacaccctctacctggagcttctgtggaaagaagggctgtcctgtgacaatttgcactaacatacttttccagctaaactctagttcaaaggtctgtgagcttgtcactttctggagttaggaaaaggcatatcaacttcttcatcaagggaaccatcctgtcccctgtgaaagattataacagccctttcccaggtaagggatgtattgtgattatctgaaatattgagatttttggtagacctggacaatagcggtaaaagcttaagcttttaccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331181 - DNA, 1594 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaacaacccacaacaacactacaccttcgcaggccactctatttccgggcgcccgaatacacgagcgtcaccgacacgggccccagtggtcctacctggtccctgaccccgcgttttcttgatcccaagttgg

SEQ ID NO: 331182 - DNA, 2212 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaaaaaacaaaaaaaaaaaaaaaaaaaaaaaaaaaaaaaaaaaaaaaaaaaaaaaaaaaaaaaaaaaaaaaaaaaaaaaaaaaaaaagaaaacaaaaaaagagagagagggcggcggcagcggtcctatgatatatctctcttccgtccagaggaggcgcgcgctactcggttcagtccccgccgacctccttattattgtataaaaacgggaggcacgcactcactaataggaggaggtgcttattatttataataagcagagcgaggacgggcggcgcagcgtatatattcacaccacacgcaccgcgaggtccgacgggacagaccaacaccggcccgcttactagcaagaggagctctaaatcttgtaacagacagggacgagcacacacctatcaactacctctttcgggctgcggggcgtgaaggacagaaatatgagtggagaggacacaaacaatccttctcctactgagccatagatctatattaagaccctgcgtagaggggagagtcgctatacatgacatacacctcctcagtcgagcgagagcgtaaagctgacgactgtgagacaacaacaccaccaaacaccaaacataatattctaacgcgcccacaggacgaaaaacagaatcatagccgacgcaacgctggacgtcagcatctaatagccctgaagacacaccaattactatttctacatcacgcagaggcgatcttgatatccaaaataataattaataaga

SEQ ID NO: 331183 - DNA, 1928 bp, Homo sapiens
  misc_feature (1563)..(1563): n is a, c, g, or t
  misc_feature (1568)..(1568): n is a, c, g, or t
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaaaaaacaaaaaaaaaaaaaaaaaaaaaaaaaaaaaaaaaaaaaaaaaaaaaaaaaaaaaaaaaaaaaaaaaaaaaaaaaaaaaaagaaaacaaaaaaaanaaaanaaaaaaaaaaggggggggggggggcaaaaatatcctggggacgagagacacccccacgcagacgctgttggttagttgttagagggggcgaggcgcaccacaacagggcggcgcgaaataaacattgaaacgaaggccggcgcggccgaccgaacaacaacagatggcgggagcggaccgacgccagaccggaggcgacggtcagctggaacaacccacatcattgtggcgggcaaacaaggaggaccagccacaccccccagaagggactggcgggcggagaaaacaaccaacgagcggcggtggtagagacccacgcaccacgcgggaggcagagacgggccggagcgcaagaccaac

SEQ ID NO: 331184 - DNA, 2144 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaaaaaaaaaaaaaaaaaagaaaacaaaaaaagagagagagggcggcggcagcggtcctatgatatatctctcttccgtccagaggaggcgcgcgctactcggttcagtccccgccgacctccttattattgtataaaaacgggaggcacgcactcactaataggaggaggtgcttattatttataataagcagagcgaggacgggcggcgcagcgtatatattcacaccacacgcaccgcgaggtccgacgggacagaccaacaccggcccgcttactagcaagaggagctctaaatcttgtaacagacagggacgagcacacacctatcaactacctctttcgggctgcggggcgtgaaggacagaaatatgagtggagaggacacaaacaatccttctcctactgagccatagatctatattaagaccctgcgtagaggggagagtcgctatacatgacatacacctcctcagtcgagcgagagcgtaaagctgacgactgtgagacaacaacaccaccaaacaccaaacataatattctaacgcgcccacaggacgaaaaacagaatcatagccgacgcaacgctggacgtcagcatctaatagccctgaagacacaccaattactatttctacatcacgcagaggcgatcttgatatccaaaataataattaataaga

SEQ ID NO: 331185 - DNA, 1384 bp, Homo sapiens
cggacgagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331186 - DNA, 1327 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactgtgatagtactcactggtctccgtgtgatccttgccatggccaga

SEQ ID NO: 331187 - DNA, 1555 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggctcaacaggaaaggggaaggagcaggggtggggctgatggtggctggagccaggtcctagccctagccctggcccaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331188 - DNA, 1477 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331189 - DNA, 1323 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgttcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331190 - DNA, 1370 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagagcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331191 - DNA, 1662 bp, Homo sapiens
cggacgagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtgagtgatctgcactagctggggagatttagatgctggccaccttcttggtgagcttgagtggtcctcttctgcctgctgctcatttgtcttgggcaaccatttggccagagcaggccttcatctcagggcagcagtttggcacagtggctaagagcacaggccgaggagccagactgcctgcattcagataccagtttcagaccttactggctgtgtgactttgagaaggtttcttaatctttttgactcctgttttctactttataaaatgttgatgagggcacttatctcacagggtgtgtgtgcaggttaaagatgatagcacggagcctggcttgtggtaggtacttgttgaaatggtagccccccgtgtccgatgatgacctgtgcatgaggctttgggagaagcagagctaggttggagcacaggttctgccacacctgggctatgtcatatttgggccctatttagttgcttcttctgtaaaatggggatgatgataatagtacccactcacagggctgttggggtgaacaaatgagatttattctcattcatttgttcattcatgcattcacaaaatatttagtaatcacctactagtctagttgctaagggtacagtagtgaacaatctgtgccctcagaacattctagtaaagaaatagacaataagtatataaaatataaatagtccccaattaacaatggttcagcttgcaatttttaacttcatgatgggtattacatgcatttttcacttaacgatattttctttttcttttttgagacagagtctcactctgtcgcccaggctggagtgcagtggcatgatcttgactcactgcaacctccacctcctggattcaagtgattctcctacctcagcctcttgagtagctgggtgtacaggtgcgt

SEQ ID NO: 331192 - DNA, 2420 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagagtgagtcagggagctccctaccagagtctcctgcgcggtgccaagcactggagttcctgcattttgttccgtcagcctggggagtgaaagctgcctcgtcctcacatggcgaataaaagactgaggcacagagagggtgggggatttgccctcccaggcagagtgcaggcctggggctgttagatttaaagcgcctgctctttctgctgccctcaccgcttctatccgttcctccggtgcccaccgtctgcctgcctcactgttctctgtggtctgcctgggctgggggttaggcaaggcaagtctctgtgtacccgctcccaaggctgccctggcctgtggagcagcatctcagcagagtggcaggatgcgaggggctgagggcagaggaagtcaggtcagccttggtgcgtctttggagagctgcttctcagcctggacccccgtgagaacacccaccaaatgctgccaggataggtactgaggacaaatcagttctctgtgaccagacatgagaaggttgccaatgggctgttgggcgaccaaggccttcccggagtcttcgtctctgtctcctctttctccctggcctgtggttgtcccccagcctctgccaccctccacctcctcggtcagccccagccccaggttgataaatctattgattgattgtgatagtaaaaaaaaaaaaaaaaaaaaaagaaaacaaaaaaagagagagagggcggcggcagcggtcctatgatatatctctcttccgtccagaggaggcgcgcgctactcggttcagtccccgccgacctccttattattgtataaaaacgggaggcacgcactcactaataggaggaggtgcttattatttataataagcagagcgaggacgggcggcgcagcgtatatattcacaccacacgcaccgcgaggtccgacgggacagaccaacaccggcccgcttactagcaagaggagctctaaatcttgtaacagacagggacgagcacacacctatcaactacctctttcgggctgcggggcgtgaaggacagaaatatgagtggagaggacacaaacaatccttctcctactgagccatagatctatattaagaccctgcgtagaggggagagtcgctatacatgacatacacctcctcagtcgagcgagagcgtaaagctgacgactgtgagacaacaacaccaccaaacaccaaacataatattctaacgcgcccacaggacgaaaaacagaatcatagccgacgcaacgctggacgtcagcatctaatagccctgaagacacaccaattactatttctacatcacgcagaggcgatcttgatatccaaaataataattaataaga

SEQ ID NO: 331193 - DNA, 1783 bp, Homo sapiens
  misc_feature (1726)..(1726): n is a, c, g, or t
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagagtgagtcagggagctccctaccagagtctcctgcgcggtgccaagcactggagttcctgcattttgttccgtcagcctggggagtgaaagctgcctcgtcctcacatggcgaataaaagactgaggcacagagagggtgggggatttgccctcccaggcagagtgcaggcctggggctgttagatttaaagcgcctgctctttctgctgccctcaccgcttctatccgttcctccggtgcccaccgtctgcctgcctcactgttctctgtggtctgcctgggctgggggttaggcaaggcaagtctctgtgtacccgctcccaaggctgccctggcctgtggagcagcatctcagcagagtggcaggatgcgaggggctgagggcagaggaagtcaggtcagccttggtgcgtctttggagagctgcttctcagcctggacccccgtgagaacacccaccaaatgctgccaggataggtactgaggacaaatcagttctctgtgaccagacatgagaaggttgccaatgggctgttgggcgaccaaggccttcccggagtcttcgtcctctatgagctctcgcccatgatggtgaagctgacggagaagcacagcctttcacccaatttcctgacaagtgttttgcgccatcaattgggggcatgttcaanagtggcttggattcatcggtttggttcatttaccatttagcaagggccatccaggag

SEQ ID NO: 331194 - DNA, 2255 bp, Homo sapiens
cggacgagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtgagtgatctgcactagctggggagatttagatgctggccaccttcttggtgagcttgagtggtcctcttctgcctgctgctcatttgtcttgggcaaccatttggccagagcaggccttcatctcagggcagcagtttggcacagtggctaagagcacaggccgaggagccagactgcctgcattcagataccagtttcagaccttactggctgtgtgactttgagaaggtttcttaatctttttgactcctgttttctactttataaaatgttgatgagggcacttatctcacagggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaaaaaaaaaaaaaaaaaagaaaacaaaaaaagagagagagggcggcggcagcggtcctatgatatatctctcttccgtccagaggaggcgcgcgctactcggttcagtccccgccgacctccttattattgtataaaaacgggaggcacgcactcactaataggaggaggtgcttattatttataataagcagagcgaggacgggcggcgcagcgtatatattcacaccacacgcaccgcgaggtccgacgggacagaccaacaccggcccgcttactagcaagaggagctctaaatcttgtaacagacagggacgagcacacacctatcaactacctctttcgggctgcggggcgtgaaggacagaaatatgagtggagaggacacaaacaatccttctcctactgagccatagatctatattaagaccctgcgtagaggggagagtcgctatacatgacatacacctcctcagtcgagcgagagcgtaaagctgacgactgtgagacaacaacaccaccaaacaccaaacataatattctaacgcgcccacaggacgaaaaacagaatcatagccgacgcaacgctggacgtcagcatctaatagccctgaagacacaccaattactatttctacatcacgcagaggcgatcttgatatccaaaataataattaataaga

SEQ ID NO: 331195 - DNA, 1391 bp, Homo sapiens
cggacgagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtgagtgatctgcactagctggggagatttagatgctggccaccttcttggtgagcttgagtggtcctcttctgcctgctgctcatttgtcttgggcaaccatttggccagagcaggccttcatctcagggcagcagtttggcacagtggctaagagcacaggccgaggagccagactgcctgcattcagataccagtttcagaccttactggctgtgtgactttgagaaggtttcttaatctttttgactcctgttttctactttataaaatgttgatgagggcacttatctcacagggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagtcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331196 - DNA, 1066 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagaaaaagcctccatgatgttaacagtactcaagtgtatgtcgcgctcaacagtgtaaaagttctttcctgtgataa

SEQ ID NO: 331197 - DNA, 1041 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccgggaacgaccacagagcaccctgggaagaggttccaacagtacaatgcgacacgtccatgactggtcaaagagaactgatttgtcctcagtacctgtccgtccacgttgatgtacacagtgggctaccaccttcacgaagtactggaacatcctggatgacttggggctccaagtaacatttggtgctaggtctcagggagttcacaatgacctggatatgtcctcccaca

SEQ ID NO: 331198 - DNA, 272 bp, Homo sapiens
gaactactggggctggggtgaccgaggaggtggagggtgcagaggctgggggcatgtcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331199 - DNA, 1290 bp, Homo sapiens
ccactagcctcatgatgttccagtactttgtgaaggtggtgcccactgtgtacatgaaggtggacggagaggtactgaggacaaatcagttctctgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331200 - DNA, 1178 bp, Homo sapiens
  misc_feature (32)..(32): n is a, c, g, or t
gacggggatcgtggtgctgctactgtctgtcnggctgagtattactcccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331201 - DNA, 1495 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctggtcccagtaccttagcctgattttcctgcttccagatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331202 - DNA, 2250 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtacagagattcgtcaaacacacaacacaaaacaaaaggcgacgacaacagtaaatcaaccctcaacccgcatccacgaggcgcccaaaaaggcataagagcgatacaccacggcaacacctcgcaccacacagacgagacacactacacaccagccgacgccaaacaaaataagcacaaagcgcacaggaaaccgtacaaaacaacacacggcaccaaagcacggcggcacaaaaccggacacaacacgacggcgagactccaggacccacacggaccccctacacaccaccgaacgacagcagacaacaaacagggacccaccgacaaacaccagacgaaacctccacaagcaacaccgagcacaccccaacaaacacccaaaaggcgacaccccgaaagcaaacgcacccgcacccaactccccccgcacgcaccacagagccatagagggatacagggggatggacatcacgcacccaatcaatccccagacacggagagggacaaacgcagcgcgccgccgctcccacgagcgacacgacccgacgaatccggggcagagaggggacagcaggggaggggcgagcatgcaggatcagaggaggggtggtcagctgcacctggcgagacgcaacgagagaacgacggaaggaccgcaggaggaagggagagacggactgcgacgacggcggagaggtggtacgcgacagaggcgatgcaaggagccaggccggaggcaatctacagtgcgaccaggagaagcgaaaaagcagagagacgggagggcgagg

SEQ ID NO: 331203 - DNA, 1950 bp, Homo sapiens
cggacgagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagagtgagtcagggagctccctaccagagtctcctgcgcggtgccaagcactggagttcctgcattttgttccgtcagcctggggagtgaaagctgcctcgtcctcacatggcgaataaaagactgaggcacagagagggtgggggatttgccctcccaggcagagtgcaggcctggggctgttagatttaaagcgcctgctctttctgctgccctcaccgcttctatccgttcctccggtgcccaccgtctgcctgcctcactgttctctgtggtctgcctgggctgggggttaggcaaggcaagtctctgtgtacccgctcccaaggctgccctggcctgtggagcagcatctcagcagagtggcaggatgcgaggggctgagggcagaggaagtcaggtcagccttggtgcgtctttggagagctgcttctcagcctggacccccgtgagaacacccaccaaatgctgccaggataggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaacaacccacaacaacactacaccttcgcaggccactctatttccgggcgcccgaatacacgagcgtcaccgacacgggccccagtggtcctacctggtccctgaccccgcgttttcttgatcccaagttgg

SEQ ID NO: 331204 - DNA, 869 bp, Homo sapiens
ggcgactctagcggatccctgtattggtggtgcttgcgaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331205 - DNA, 1519 bp, Homo sapiens
cggacgagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtaaaaaacaacccacaacaacactacaccttcgcaggccactctatttccgggcgcccgaatacacgagcgtcaccgacacgggccccagtggtcctacctggtccctgaccccgcgttttcttgatcccaagttgg

SEQ ID NO: 331206 - DNA, 708 bp, Homo sapiens
ggtcggtaccagtgagtgctcgtcaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331207 - DNA, 1374 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtctccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331208 - DNA, 1322 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331209 - DNA, 1101 bp, Homo sapiens
  misc_feature (1074)..(1074): n is a, c, g, or t
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagagactgaggacaaatcagtnctcatgtctggtcacagaggtcgacgc

SEQ ID NO: 331210 - DNA, 1348 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331211 - DNA, 1318 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagagatctgagacataatcaggttctttgtgaccgcagacatgagaagtttcacaattggcctgctaggtcgaccaaggcgttacccgagatgtagtatcgtcccgctatgatgcttctcaggcctcatgatgtgtgaagtctagactggagaagcacacgctcgattcatccacttctagacaggtgtgtgctgccatcattgggggcatgttcacagtggctggaatctatcgattcgctctacaatattacatgtacagccag

SEQ ID NO: 331212 - DNA, 1220 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagctccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331213 - DNA, 1160 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacgtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 331214 - DNA, 807 bp, Homo sapiens
cggaacacaacaaaatcatatcaacgcgtggaaaggaaaataaccaccaatctagaattctagaacaaaggtgaaatagacatttccagacacacaaaaaccaaggaaatgcatcaccaacagacccacattaaaggaaatactatagcattctttaggcagaacgaaatgatcccagatagaaacttagagatgcagaaagaattcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgcagattaatgcaggacaccagtggaaccaacataatttgctataggactggatgtggagtggaggagagcaaagtcatggttgttgattccaacgctttcagcctgagcaaatgaatgacttgagatggagatgactggaggagaaggtttttttggtgggagggaggagtggctattggatatccactgctgtgtaacaaagtactccaaaagttagtagtttgatacaataaaaatgtgttttttcagtttccctgggtca

SEQ ID NO: 331215 - DNA, 6830 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagtt

SEQ ID NO: 331216 - DNA, 7250 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331217 - DNA, 7172 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331218 - DNA, 7066 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331219 - DNA, 6902 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttcctggggggttctggtttttacttttttaatgtaagtctcagtctttgtaattaattattgaattgtgagac

SEQ ID NO: 331220 - DNA, 3536 bp, Homo sapiens
actccggcaggcacaagagccaggaaggagcactgagctggagctctcttgcatttggggcttgccgcctcccagctctgcgtttctgcaagctgatggccaggagccaagctacgctgaggggctgtgggggcagtgagcgtgccacccacacagagggactgagcggaagacgcacaccgctcccttgtcgtgtggcacagctgtgtcactgctcttctaaacgtggagaaagccccttaaactccaaatggccaaaggctttgcagtccttggtttcacatccgtggcaccttgggtggagttgcttctgtaagccaacagatgagcaggtgaggagcacagcgcggaccccagagctccctgcaggacgcccttagcctcgcttgcatatgccctcagaccgggctgcagaggggcttcccacgcccccatagcacgggttcctaggggtctagggtcattagtgtggagggcagacaggcagggttgttgcccagaggtcagcagtggtttctgtgtggtttttaatacctacctggaaaccggacttgccatctcctacggaagaattagcctcaccatactgaacagtcggcccctacctgaatttccaaagtgttgagcctgaattagtagctttcaggataatcacatctcatgagagctaaatgaaaaaccagactttttaaaagtcaccttcaacatctgtactgtagtattcaaaatattagttacggaagtgattgtggagcatttaaacattggattgtgtttgtttaaactttgaaatgaagatgaattccagagtgggaacatgaagtctttggtgacgtgaaccagctgagggcagtgctgccgcctctgcacttgttcaagtgccaaggcttggcctccggcccgagggcaggtgagttcctgagccactgtggctcaccccgccctgctccgtctgcgctaggttgcagccccacccacgtcacggtgtacagcgagtatggcgtggacgtctttgatgtgcgcaccatggagtgggtgcagaccatcggcctgcggagggtaaggcggcctcggtgccctcctgtgcgggcgggcttctcccggtgcagtctgtgcgtggccgcgcttactgtccctccctggtttccaatccagataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331221 - DNA, 2204 bp, Homo sapiens
cggtggttacgtcagtgagggggcgggggttgtaaatagacttgacgggcggtccgatataagatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331222 - DNA, 5143 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagtatgtatatgttttctgttgcatatccctgttgctgcttttcccaccgacagtcagcatgtgttcgattttgctttggtttgtcttccagtcccttagttgagtagtcacagagcatcgggagaggtgggccccatgccagcccgcagcagagagcatggttcagatctcacgtctcagaccagcagtaggcgggctcagcaacctctctccctgagcacatggggccggttcttccagaggcctcagcagaggaccccgtcggcgggcataggcccctgggcagaagggctcggcgaaccgagaacggggcgtggcattcatctctcatttaaaaggccttcctcgtgataatacagaaacttacacagt

SEQ ID NO: 331223 - DNA, 2244 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagtt

SEQ ID NO: 331224 - DNA, 1393 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgagttgcatccaaagaacaccatacctacagtgaagcatgggggaaacatcatgctttggggctgtttttc

SEQ ID NO: 331225 - DNA, 367 bp, Homo sapiens
gtatgaatttttcattaatctttttaacaaagcacatggttaaaactgattgttctaggcatgtcattgtgctgcggcagccatcagcgcacctccagtgtggccctagggtctcaacctccagcctggctccaggtccttgtgcgtcccgtcctggccaagtagcagcctgtgcccgtctcggggagcctcctggctggcttcttcccagacacccctcttcactgaccctcccttctcctacatctgaaactcctcttccactcagtccacgtcccggccactgtcctcacagcgtgtgcactgccaggcgggcgctgtggcaggttaggcatgaaggtgcctctccagtgccccccagccaatt

SEQ ID NO: 331226 - DNA, 431 bp, Homo sapiens
atttgcatccagctgggcacgcgtgcctccccaggctagggcagcgggtgctcaccctgccctcttcctgttcacagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctg

SEQ ID NO: 331227 - DNA, 430 bp, Homo sapiens
tgcggacagtacagttggccccggctaagcctgagggtcagctccaggagccccacacacacccaaatccttgcagactcaatcccacagtcagccggccctgtggagttcgtgtagagagaaagtcacccccgatactgaagtgtcacatccctggaatgctgtattctcatccacatatggttgaaaagtatctgtgaatgagcccacccacgcattcaaacccatattgttcacggtcggctgtactgactttgtgtatgttacttacccctccacagatgcagacaggattgcagtcggcctagaagaagggctctatgtcatagaggtcacccgagatggtgagtgagcagggcgtttccagcctgggatgtcacaggcccagcctggcctctgcagacagcacagggtcagtagctcctaaggg

SEQ ID NO: 331228 - DNA, 414 bp, Homo sapiens
cctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcag

SEQ ID NO: 331229 - DNA, 613 bp, Homo sapiens
  misc_feature (577)..(577): n is a, c, g, or t
ctgttctagaggatccctttttatagcacgctggagtgggtgcagaccatcggctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccancaaacactcaactccagacgatgctgatgggtaccg

SEQ ID NO: 331230 - DNA, 5182 bp, Homo sapiens
ctaccttgtctcgcctctaccctgtctcggctctacccttgtctctcggctctaccttgtctctcggctctaccgtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331231 - DNA, 3440 bp, Homo sapiens
actccggcaggcacaagagccaggaaggagcactgagctggagctctcttgcatttggggcttgccgcctcccagctctgcgtttctgcaagctgatggccaggagccaagctacgctgaggggctgtgggggcagtgagcgtgccacccacacagagggactgagcggaagacgcacaccgctcccttgtcgtgtggcacagctgtgtcactgctcttctaaacgtggagaaagccccttaaactccaaatggccaaaggctttgcagtccttggtttcacatccgtggcaccttgggtggagttgcttctgtaagccaacagatgagcaggtgaggagcacagcgcggaccccagagctccctgcaggacgcccttagcctcgcttgcatatgccctcagaccgggctgcagaggggcttcccacgcccccatagcacgggttcctaggggtctagggtcattagtgtggagggcagacaggcagggttgttgcccagaggtcagcagtggtttctgtgtggtttttaatacctacctggaaaccggacttgccatctcctacggaagaattagcctcaccatactgaacagtcggcccctacctgaatttccaaagtgttgagcctgaattagtagctttcaggataatcacatctcatgagagctaaatgaaaaaccagactttttaaaagtcaccttcaacatctgtactgtagtattcaaaatattagttacggaagtgattgtggagcatttaaacattggattgtgtttgtttaaactttgaaatgaagatgaattccagagtgggaacatgaagtctttggtgacgtgaaccagctgagggcagtgctgccgcctctgcacttgttcaagtgccaaggcttggcctccggcccgagggcaggtgagttcctgagccactgtggctcaccccgccctgctccgtctgcgctaggttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331232 - DNA, 2150 bp, Homo sapiens
ggcctggtggcgaattcggcacgaggcttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttaaaaaaaaaaaaaaaaacaaaaacaaaaaaaacaacaaaaaaaaacccactctcgcgggcgcatctcttacttgtccgcggtgtgcgggacaaaaagaaagagggtgtacagcgaacaggggcgcgccccgaggggcccccaatgagccgcgtgtgtaccaccgcggaaccccccccagttttttttgctggtggttctacacaagaggagggggggggggataagcaaaaattccggagcggcggcgagggtactcaacacccccccataatattaatgaggggagagaggccctcctcctctcattaatatacaaaagttgcgcccagcaatatgacagccgcgccgggggggttattataaacaccaccctgcggggaagatttgaaagaggagaaaaataacacgggggggacaaa

SEQ ID NO: 331233 - DNA, 6317 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctggagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagtt

SEQ ID NO: 331234 - DNA, 1244 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtaggtatttttgttggagattttccatttggttttgggtttggcatatagtcagaagggaagttttcaatttgaggtacaattaagaaaccaagtatattaattcagaaaatgaatccattttggagatagttgaaattttctgtttggggagttttgtttcccaaataaaaattaagttggaaagcatc

SEQ ID NO: 331235 - DNA, 4123 bp, Homo sapiens
cggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcatgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatc

SEQ ID NO: 331236 - DNA, 2128 bp, Homo sapiens
  misc_feature (731)..(731): n is a, c, g, or t
  misc_feature (1431)..(1431): n is a, c, g, or t
  misc_feature (1448)..(1448): n is a, c, g, or t
aaacaaagcaacttctgctttttcactgttggccacaaacttaaatttctattgtaaatatcctcataagccaagttaaccaatgaaatgccaattcctatggtttagtcatgttacctgtgtttagaatttaggtttcaccaaccaagatatataagacagggctacagaatataactcatataagacaggggctggagaccgtaactccagcagtaaaacagtcactgaactgaaaatgcttatgcagactaggggagttcttagccccatggagaagcttctgtcagagggaaagcaggattcttttggaggcagtaatgaacaaaggtgtctgcagcctgtgctctgagcacccctttctatggcaggagagtttcctgcagggagccatgcagtgtggatatgaagggattctattcattgagtgtgagggaaaccagatgcttgggttccaacattctagatatttcctaaagcttgtatttcttttccctccactagatcttcctggttcataaatctaccaagatgcagaagaaagtcctctccctccgcctgccctgtgaatttggggccccactcaaggaatttgccataaaggaaagcacatacagtaagtggtcattggatgctcaggtcctgactgacagggccacggggctctgcagggagtggaaatggaaggagctctggttatgagatgggcagatatgggcctgagtcttggnactgaatgactaggcagataacctactccaggagcctcagttttctcatctgtgtaatgggatgatggtaacctctgagatgttaatgagtcaaacaacctgaatataaagtgtgcagcctactgcatggcatatggtagggaactaatagaggttgacttcctctccccctacccagttaagtggaacatgaattcagttcccaggtttgccagtgactaagttgcaaggagactgtagcgagagagccctttcacgctaatcctaaatcctaaagcatgtgtctgcacttcttcgtgaataaataatccctgagcagacctgttccctccaggcaatcagtgttcagtcttctatgaaatgcagctaatcagaggcagaatccaaccttttgatgaacattttgaagggagagtggtgttcagaagtgttggttttctttctgctgttccacgattggtcattggaaatgtgaagtgtcgggaggccaaattttaaataaaaaagggaacacccagttctgatgtactgccagcctccaagaaaggatcggaagatggatctgcacatcaaagggggaggagtgggaggagcaggccaggaggagagagctcagaagcaagacagagcctgggattcccacttgcttcccgatttcccagcacctcacctcctgcatttggagaagctgaaggtgtanatgaaggtcaatttcanggccgagatgagattctactcagccgggagggcacaatcttgctgagccaaatgaccattaactgagttaggggagggtaaaacctgccaggctgactgtgaaccgcctccagctcaattgtcaacctggatcttacaagtccacaaggtcatggatgccagggaaaaacttccccctgaaaggcgcacaagcaggcggaacccagccaataatgtaaatacattaggatgcaaccagaaggtacattgcaaacccactgcttgaaaggtaataaattcatattgagctaataatgtgttaggtgaattgataatgaatttatattaagtgaatcaattaagtaattctgaattggcttttgaaagtctgcgagaggctgggcaccatggctcacacctgtaatcctagcactttgggaggccaaggccagagggttgcttgagctcaggaatttgagaccagcctgggcaacatggcaaaactccatctccaccaaaaaaaaaaaaaaaaattagccaggcatgatgacacacgcctgtagtcccagctactaaggaggctgaggtgggatcacttaagtgcagtgagccgtgatcgtgccactgcactccagcctgggcgacagagccagaccgtgtcttaaaaatgaaaaaacaacccaaaaatattaaaaaaaaaa

SEQ ID NO: 331237 - DNA, 3989 bp, Homo sapiens
cggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcatgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgggcgagtgttgggcataacatcacggatccgcagg

SEQ ID NO: 331238 - DNA, 424 bp, Homo sapiens
gcagatgtccattgtaagaaagcagatgttgcatttcttctttcttcagacaatagtcatagtagctacactttctttggcagatgtggtgctggaaaaagccatgcacaagtgcatcttgaagcccctcaaggggcatgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcaggtgaggccgctggaagcccaggcttcgtgccgctt

SEQ ID NO: 331239 - DNA, 479 bp, Homo sapiens
ggaggatgtatggcgctgatgacttcttgccagtcctgacctatgtcatagcccagtgtgacatgcttgaattggacactgaaatcgagtacatgatggagctcctagacccatcgctgttacatggagaaggtaactgcttttgagaaaagttgaaggaactgggtgctatttttttcatttttttataattgagacgaaattcatgtcacataacattaatcattttacagtgaataattcagtggcatttagtatattcacaatgtcatgcattctccacctttatttagtgtcaaactattttcctcaccctaaaataaaattctgcacccatgaagcagttacttgggtgcttttttgacatcttaagtgttaactgaattttttattaatttaaaagagtgtactaacctttttctgattgcaaaagtaatacacactcgtggtagaaaatttggaaaagtcaggaaaaacac

SEQ ID NO: 331240 - DNA, 4050 bp, Homo sapiens
cggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcatgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatc

SEQ ID NO: 331241 - DNA, 3134 bp, Homo sapiens
cggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcatgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttacaaagagccttcatgtttttttatattgcatgtacagatatttaaatttttatgaagtgaaaatgtccttcttttgcctgtctgccttccttcctctctctctcataggatccttttataacgtggctcattaagacatagttaatatgctacatacatgaataa

SEQ ID NO: 331242 - DNA, 713 bp, Homo sapiens
ggtaagtgcctgcagaagctagaggcaagtcccagctctcttgtatagctgatgtatgccctgagacatactccatttgtaggattctcctgtgctccaattcaccaaattctgctgatggctcagagcagggtaaagcttctcctagataatccctcccccaaaattgagtcctcggggacagttatttattgaataacctccaggttatctactttgggaaatgcagaaatgctataaactgaatttttttccagcagtggcagaagccagacaccttgaagtcaattgtccttcattctccagagttcccaagtggcatttcagagcacaggaattcactcttccacccagatattcctctcacactgagtcacgcaccccagtttctagcagcagatatcttgaagccaaccaccctaatgaaaaatgcgggtttccacaccagttttccacaccagctctccaaccattaagagtacacatgcccccatggcacacttgggttatcacaataaaaatacgtttatataaagtaaaaaacataatgtggagcaaatatatacatatacatgtacattgttagagttcaagtgaatatacagtttttaagtgtgtaaataaatttcatagcactacaaaaatacaagtcatctgagagacgtttacagtggtccccaaaactataggagagaataaaataaaatagctat

SEQ ID NO: 331243 - DNA, 471 bp, Homo sapiens
acaaaataacaaaataaaactactttcatctttacttagttgataggtgaaccactgcagtttaccgtgctagtttattttcttaattagtagtgtggttgaacttttgcctgtatatttattaccttaacatatctcttttcttctctcgattcgtcagttctgatccattgcctacttgctaaatttagtgttcatatttacacgtggtcatttttaactataaaataacataaacctctcaaaatatcacagagttggtctgggagctctgtatttccagggaccaaggttccattatcctattgctttgccacatgtatcttttattcccaagttgtccagtatggctgctggagctccagccattaggctttcattcctagcagcaacctggaggaagtagtgaagaagaaggaacagagaacactcatgagctttaaggaggtttcccagaacctacggataaca

SEQ ID NO: 331244 - DNA, 104 bp, Homo sapiens
tgtttggaaagacagcaattctcttcctcaatctttgtcatagcatgagtatttatttgttccatctctctacgtaaaacaggaaggatttgcacaaaagtgtt

SEQ ID NO: 331245 - DNA, 578 bp, Homo sapiens
tcccaacaaagaaaagactagggtcatatggtttcactagtgatttataccaagcatttaaaaagaacaccaatctttctcaaaatcttctaaaaaaaaaataagggaaaatacttcaaaattcattttatgaggccacaattaccccaataaaaagccagataaggacactacaagagaagaaaattgcaaggcaatatcctcaatgaacatagatgaaaaatttctcaacaaaatgctatcaattatcaaaaagacaaaagacaagttttggtgaagattggtgaaaaaagaacccttgtgcattgttgctgaaaatggaggccaggcacggtggctcatgcctgtaatcccaacactttgggaggccgaggcaggtggatcacctgaggtcaggagctcgagaccagcctgaccaacatggtgaacccgtctctactaaaaatacataaactagctgggagtagtggcacacgcctgtagtcccagcaacttggaaggctgagaccggagaatcgcttgaacccaggaggcagaggttgcagtgagccaagatctccccactgcactccagcctg

SEQ ID NO: 331246 - DNA, 158 bp, Homo sapiens
ctttcaccaacactacactgtcttgtttactgtacctttatagtaagtctcgaagctgggtagtgtcaatcctccaactttattgttgttctttgggattgtattggctattctgggtcttttgcctttcagtatatacactttagaatcagtttgtt

SEQ ID NO: 331247 - DNA, 3970 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtatcgacagcaacggaattcgagctccgtc

SEQ ID NO: 331248 - DNA, 6144 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331249 - DNA, 6211 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcaggatatctcctcaccttgcttacgaacaggaatttcagcaacatcaccccagagccctgacttaaaatccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331250 - DNA, 3964 bp, Homo sapiens
aagaatttgaaggagagaggtgacaggattggctttgtagttcagagtgattgctttgatgtggatggtttctctttgtcacaagcaaagagggtggtgccatctgaaagtctctgtgaatggctgtggtcagtgtcattcactgtcctctaatttttttcaggaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331251 - DNA, 3503 bp, Homo sapiens
agcactttgggaagctgaagcaggtagatcacttgaggtcaggagttcaagaccagcctggccaacatggtaaaacccccgtctctactaaaaatacgaaaattagctgggtgtggttgtgcacgcctgtaatcccagctactcaggaggtggaggcaggagaactgcttgaacacgggaggcggaagttgcagtgagccaagatcgcgccactgcactccatccggcctatgagactatgtctcaaaaaaaaaagagcatttattatttttccctctcaaaagaatttcagatattctggttaaatctcaccccatattttctcttcccgtttttgagggaggcaggaaaacaggattcagtatgggcatagcagaagactgaaatctcattccaagctcatagttaaaaagaagtctgcatatgaacccatcagtagagaagtggctaagtggttgtgggattcataattaaccatgactttctctcttaggctgtatttttgtctcgtcccagctcttctgcctgttactgacctcacctgtagctgtttcttccagcttcctttgctctaacttccagctcatctctcatcttgttattttattcatcaggatatctcctcaccttgcttacgaacaggaatttcagcaacatcaccccagagccctgacttaaaatccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331252 - DNA, 3188 bp, Homo sapiens
ctcagttaacaacctggaataccttcaaggacacaaaagcactggaataccttcaaggacacaaaatcagtaaataaaaccaaaaggcaaacataagagccttttctctaagttagaaacccaggcctgcaactcttctagccagttggctagaagtgaatctttgcaatgattgtgcccagtagtagtgaaggcatttgaaagctaagaacaaaatctatagctgactgttcctggtgtcactcagtcaatggagactttagtagcgtgcagcctttggaatattcttgtttagaatcaatagagtgcagtgtacaaacgcttacttaccatttcattatttccccaccccctcttttttgaaagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331253 - DNA, 2374 bp, Homo sapiens
  misc_feature (19)..(19): n is a, c, g, or t
tcagtgtaccccggagtangcatatgtggacgcgcgtcgggagacagaagggcttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331254 - DNA, 4712 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccgtcgggtggagccctccaccccgtcgggcggg

SEQ ID NO: 331255 - DNA, 2161 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggtaagccaggccctccaactctttctcccaccttcagagatgagacttgcagatactgtaaaatttcagtatggtcatgctgttgagaaacatatctcaggctcactgtggagatagttttttaaggagttttactatg

SEQ ID NO: 331256 - DNA, 760 bp, Homo sapiens
agcactttgggaagctgaagcaggtagatcacttgaggtcaggagttcaagaccagcctggccaacatggtaaaacccccgtctctactaaaaatacgaaaattagctgggtgtggttgtgcacgcctgtaatcccagctactcaggaggtggaggcaggagaactgcttgaacacgggaggcggaagttgcagtgagccaagatcgcgccactgcactccatccggcctatgagactatgtctcaaaaaaaaaagagcatttattatttttccctctcaaaagaatttcagatattctggttaaatctcaccccatattttctcttcccgtttttgagggaggcaggaaaacaggattcagtatgggcatagcagaagactgaaatctcattccaagctcatagttaaaaagaagtctgcatatgaacccatcagtagagaagtggctaagtggttgtgggattcataattaaccatgactttctctcttaggctgtatttttgtctcgtcccagctcttctgcctgttactgacctcacctgtagctgtttcttccagcttcctttgctctaacttccagctcatctctcatcttgttattttattcatcaggatatctcctcaccttgcttacgaacaggaatttcagcaacatcaccccagagccctgacttaaaatgtgaggctctttttcatgattttttttccccttcctcgtcttcagaacttaactcaaatgccagccgggttaggacttt

SEQ ID NO: 331257 - DNA, 500 bp, Homo sapiens
cacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggtttgttattttattcagccataccgttgttttccaattttcctgtcccccaagtagatcttgcatcttcatatccgggatgaagaagttgtgtaggataaacttggttgtttcactttccttactaaatttaggtacattctccctgttttcc

SEQ ID NO: 331258 - DNA, 3525 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcaggtaggaaatggactgtgagccccatgggaatgcccatttcttctcccttaagatcttttgtcagctcagaaatgtgtttggttgggttggttggttggtttgtaaacagatattcagcttcatggtgtcttcttaaaaaaaaaaaaaaaaaaaaaaaaggttcacggccgtatgaaggtaaaacaggctcttctgccagaatttctggtgcctttggaagatgttcttcagtaaagaaactacagtaatgcatttttagtagagctgcagaaagcatcggttgtgacagcaaaatcataat

SEQ ID NO: 331259 - DNA, 6090 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaaaggttgccaaagtgccagccatgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331260 - DNA, 4151 bp, Homo sapiens
gtgccccagaggcagcacacactctgtacgggggacatctcgtgcttttttccctttctcttccatgacgctcagggctaggcattgtcactctcatgcttcacagcctccggtactcagaggcagttctgtctttcctgattagctcctttcctgaaggatctagaaccctgactgggcatgccagtgtgggagtcagcaagcacgcggctatgttttctcttgcagttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccatgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtgg

SEQ ID NO: 331261 - DNA, 2472 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagtgagtgcctgttgttcttgggagaggagctgactttacacagtgctgcattgtcttttatttcctgtgagactgatgttatgaagatatgcttatctaaacaaaactggcctttggccctgagaagaa

SEQ ID NO: 331262 - DNA, 2436 bp, Homo sapiens
cgttgctgtcgaaaaagggtgaaagagaaacttggcgacctcccggaggagttcgcgaagcgaccaggagcgtgtgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccagatcctgggatccagacacaacctgcggtaccgact

SEQ ID NO: 331263 - DNA, 466 bp, Homo sapiens
cccattttttaagatctttcctctgttttccaaattttctatattgtaattatagcacttttttgatgaaaaattacttctaaacttttgtgccaagttactcagcacttttactatttgagaacacggaaactgatggaagagtgctacaaacttacacaaatgccaacagaaaagtgaggagataagattccttataaatatcatcaatgtgaaatggtaatacacaacacacattagttgtgtaccatatgaaatggctggtcaaacatctcactcactgtcccactggacaacttatctatgggcgttacagaaataatttgttggcattatgactcagaccaccagcagactatggtacatataaaatcttctcattaagctgctacagatgttgtgaatactatgttagttgtttgtttctagttttgattttttattattgctgttatgccaactcggg

SEQ ID NO: 331264 - DNA, 119 bp, Homo sapiens
ggaaaatatttgggccaacttccaactgattatttgttaacgtttttttttttctcagatgaagccttgtctaactaaaaatcccctatttcttatttaatcacccagcctccccttgg

SEQ ID NO: 331265 - DNA, 613 bp, Homo sapiens
agtttcatctcatggaggcaggatttagaaagtgtagatctctttgaagagaggtttcagggagagaggtttcagggattagggtccagccagctccctcccgatgccagccttacctgctaagtgccttctaagctttcccactcaccctgtctgtgtttccagcctcttgtgtttatctctctctccagcccacactgccttttggccgaaaagggccataccttgagtccctgttgcatgaagttggatttcctttcatgtgtcctcagaggccctggcttgggtgttgtcatggcattttgtgatttgatggaggaggagagatagagcggccccatcgcctgtttgcgctagcctctctcagcttgaccgatgactgtgatgacatctgtggacagtaagcaggtccctggtgggattgagtttcctgagctattccatatcagcattcgagaagccagtacactggctgctaattgtgctagcttgtacctggggctgggtttgggtttcaggtccctcccttcctccctttctcccaatgcttggtcttattaggaaacattgcatcgctaaaataacaattactctacagatagagtaatagaag

SEQ ID NO: 331266 - DNA, 237 bp, Homo sapiens
aagcctcgccattgcagggagacagagaaatatactaattttgcatttaagtacagaggaatccctcctgacattttgttagaaagcctgtcatgtgtcgccttgctgctgtgagtaataagacagcacagtcccctgggctggcctgataatagtcaaaataccttacatgtacacaaggtttcctggtttaccaaaaaacattttctttcaccagcgaagtgaggatcagtatcc

SEQ ID NO: 331267 - DNA, 278 bp, Homo sapiens
tctcagctcactgcaagccccgcctcctgggttcacaccattttcctgcctcagcttcccgagtaactgggactacaggcacccgccactacgcccggtgtgtgagacggggtttcaccgtgttagccaggatggtctcgatctcctgacctcgtgatctgcccgcctcagcctcccaaagtgctgggatgacaggcgtgagccacggcacccggccatgtatggtcggttttacactgagccattccattcccagggacgtgcaggagacagatgcc

SEQ ID NO: 331268 - DNA, 1564 bp, Homo sapiens
agggggcagggcctctgggatctggggtcacgagttccaggaggcctgcttctgcttctgcccagcagttcactcttccctccactgcagctgaagcttgagctgctgcggggcccacctggccagaggcagaagggagccctccgtcccaggcagcgtcctggtgggtgtctgtcctgtgccagacactggccacagaggctgagaaaggagaggaccccagcctgcctctggaggcccaggggaggcagtgaagggcccaaggctggtgatgcaggagtttccagagcgcagggaaatacagagcaagaaacgccagccctcagctccactggggagccacgcaacctctaccggtgctgaggggttacaaagctctgttaccagccccattcctcctggatgggcgaggtcggtccgtatcacacccccaacctcttgtgctctgcgacctcagaatacacggagctgtgtccacaggcctcagcggctgtgagcccctcgcctacactggggggtcctcagctgacacctgagccagtgtcctgtgccccagtggtgccaggcagagtccccctccctgacctgacttgtgcacctcgtcacccaccgccagcagtgtccccccacaacaggcttgctcagtacagcacccaacccaagtccccagcacccacaccccagtgagtttcctgtgccctataggctcagctgcttctcgtctccccccacttgggatccttggaacagggagtggttcttatttaggtccctgaggttaccaagcacaggctttgctcttagcagccgccactccagtgatgaagccgttagcagactggcctctgcagagctctgcggggaggtgcctggcttctccggcctccaccctggcccagagctgcctcctgagcagcggatcccaacctgcctgcccctggggctgggtctccagcagtcaggactgagttgttgctagctgctgacaggtgtggggcgaagggggcgcatttgccgcatgtccccattggcagcatctccacgccttcccttgtgacacctccaaccagaatagagcaggtatgtgggagcccgcacctgctcccccagcgccccggggtcgtcttctgcctgctccttctgtcctccacactgaagagtgtgctccagctggggatgggcatgtgtgacgctggggaatggatacctgtgaaatggtggagtgtgcatcaagtctaaatagccgctcgcaggatctgggggctttttgttttcagaaacctgatctgatctttataaaaagtgctcccccactcagtcagcctgggtgtccctcccgtccaggccagcagcgctgtctggctcggcaaggaggggctgaaactggagagcccctgggaaggctcttgtgggccaggtggcagcggggagggtggctcttgttccccgccctcatcctagcgttcagcagactgccccacaccacaggtttccattttcacccttgggttaagagaaaagcagaaataaaaagtttctaatgttgcttgcgaaattcagcact

SEQ ID NO: 331269 - DNA, 401 bp, Homo sapiens
tttttttttttttttttctgggacggaatctcactctgtcgcccagtctggagtacagtggcacaatcttagctcactgcaaactctgcctcccgggttcatgccattctcctgcctcagcctcctgagcttttcaatttcttatcaagctaaacatataattcagcaagcatgctcctagatttttactaaactgatttgttaatttttgcccacaaaaattctatttatatttttatagatgctttattcataattaccccaaactggaagcaatcaagacgttccccaagaggagaacagatagtctgtgatacatccatatggtgagataatattcaatgataaaaagataagagcaatcaaatcatgaaaaaaatgaaagaatcttaaatgcaaat

SEQ ID NO: 331270 - DNA, 143 bp, Homo sapiens
tgaaggtgaaaaacttggtgggaacatagcctaaaagtagacaaggtatgcatttcaaagcatagcatttttgacagagtcagaattggctctgttaatatttttacctctatagcttagggtagactagcagagccaggtat

SEQ ID NO: 331271 - DNA, 145 bp, Homo sapiens
tgatccaaatatgccatgtttagtggtcaaacaagaccagaaaaagaaaatgggaaacctctcacactttccaaaatcagtgacccctttacttgatgggccgagggctctcacagcgtagcttttttttttttttttttttttt

SEQ ID NO: 331272 - DNA, 470 bp, Homo sapiens
aagggcctctttggcctggcgggcagccggccctccactccccagctgtcttcccctggagggagatgctgaccagctggaaccttattccctcctattgaggccaaatgaggggaggaatggtggagtggctttctgggggcagggaggcagctgctgaagccaggcaaggaggaagaggaggatttccctgcctgccgaaggcctcggccttgggagaaaggcagactgctgggccagccttatctctgccaggcctgtccagcctctcatctcctgaaaaagaggattctgcccctcactgggcaggagagaaaagcagggctgcagcagcaacaagcttatagccagcccggcaagggaagtgctgggcctggcacaggatcgcccacgattggcctggcttgggtttgaagagggccttgaaggggctggggtagtgcgattgtgagtggcccttactaggctca

SEQ ID NO: 331273 - DNA, 750 bp, Homo sapiens
ctcagcctcccaagtagctgggactacaggcgcccgccaccacgcctggctaattttttgtatttttttaagtagagatggggtttcatcatgttagccaggatggtgtcgatctcctgacctcatgatccacccgccttggcctcccaaagtgctgggattacaggtgtgaaccaccacacccggccttttttttccttttttaagatagggtctcactctgttgccgaggttggagtgcagtggcaaaatctccatgaactacagcctcaacctcttgggctcaagtgatcctgcctcctcactcctcagcctcctgagtagctgggactacaaacatgagccaccaagcctggctaatttaaaaaattgttttgtagggacttactatgttgtccagggcagtcttgaactcctgggatcaagcgatcctcccaccttggcctcccaaagtgttgggattacaggcatgaaccaccatgcccggcctcttaagtgctttgtcagtggctcatgctctgtgtgctgtgagaagaagggtgaccatgacccagttctgccagcattgcctgtagtttagcaaacagctgagacaatatcttattttaaatgctgctttgctcatttgttcagcaaatgtttattgagcacctgctaggtgccaggcactgaattaagggctggggttacagcagtgagcaaaacagacacaattacaatgctcgtgacatactattccttgggaagata

SEQ ID NO: 331274 - DNA, 487 bp, Homo sapiens
ctttaggttgcacagatacaaaaagttggaagggctgaataaaagacaagctcctgttcaagtgacctcactgctttctgatgacccccactggctatgccacatttctggtgctgaatggatgcacaacacgtccgtactcatctgggcttcgatgcagttgttcaatttgaaaagtaaagcagtactttaatggtcccttcagttctcacactcagtgtttcaatatttgtcctgttctacctggcttgtaatcaatcctaaaacttcctcacatttccagatgatggaatgaacaatcctgcgtatggcttccaaactgaaaactcagaacttaaggctctggtctgaagtggccacagttcatctctggccttgacaagccatttgttggccgtggaactcattacttgaaagagatttgctacagctcccgttatggtgcctttagaagaaataaagatctcctgcctcacttccaatactt

SEQ ID NO: 331275 - DNA, 380 bp, Homo sapiens
ctttaggttgcacagatacaaaaagttggaagggctgaataaaagacaagctcctgttcaagtgacctcactgctttctgatgacccccactggctatgccacatttctggtgctgaatggatgcacaacacgtccgtactcatctgggcttcgatgcagttgttcaatttgaaaaatgatggaatgaacaatcctgcgtatggcttccaaactgaaaactcagaacttaaggctctggtctgaagtggccacagttcatctctggccttgacaagccatttgttggccgtggaactcattacttgaaagagatttgctacagctcccgttatggtgcctttagaagaaataaagatctcctgcctcacttccaatactt

SEQ ID NO: 331276 - DNA, 158 bp, Homo sapiens
ctggtgtgtgtttgctggtagctggtgttcggaggtagctggtgtttggtggtagctggtgttttgtagtagtagctggtgtttggtagtagctggtgtttggtggtagctggtgtttgttcagtggtagctggtgtttgttcagtggtagctggtgt

SEQ ID NO: 331277 - DNA, 203 bp, Homo sapiens
agagcctccacctccagccacgggtttgccccatgctccctccttgctgagctcctgcaaccttgcttacttcctagagaaagcaccagcctctgagtccccctgctcagccctttcccatctacaggaggtctcaccacccagtcttaggcccacgaaatggccttggcacctgccaaagactttctcaagtttgtgaaaag

SEQ ID NO: 331278 - DNA, 192 bp, Homo sapiens
ctggttccagagccagattgcctgggttcaagtcccggatctgcatacattcacgtgtgaccttgggctggcctctggcttcagtttcctcatctgtagaatggggataataatagtatctactttacagggctgatgtggggctcagatgagagaattcatgaagtgcttagcatgcttctgggtacatag

SEQ ID NO: 331279 - DNA, 2373 bp, Homo sapiens
ctcgctgcagcgggagctccaggtttatcctcagtgttctgtgtcctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagccttt

SEQ ID NO: 331280 - DNA, 549 bp, Homo sapiens
ctcgctgcagcgggagctccaggtttatcctcagtgttctgtgtcctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtgaggacaacttgaatatataattcataatataccctgaagattttatttctcttttttgtagaatgtttgttagtaatttattctttgcaaagtggtagaattacaggcataagccactgcgcctggccatattttatttatatttctgtataatttttattatgaccacaaagataaccctgtaatcaataacaatttaattgtacattcacaataactaaaagtgtataattacactgtttgtactacaaaggataaacgctagaggtgatggatacc

SEQ ID NO: 331281 - DNA, 2030 bp, Homo sapiens
ctcgctgcagcgggagctccaggtttatcctcagtgttctgtgtcctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaacccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaaccattaatgcctactcacatcttactgaacagaagaaggttcatagttaataaagcattaaaagtgcaattactgtcaaaaaatctttcagaaaatagaagtctttaaagtgaagaatatttattctgaagacagccattacaaatataaagggggttgtagtgcctttacttgtgtcacagatcttagtgcacacatgtagt

SEQ ID NO: 331282 - DNA, 2067 bp, Homo sapiens
ctcgctgcagcgggagctccaggtttatcctcagtgttctgtgtcctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaacccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaaccattaatgcctactcacatcttactgaacagaagaaggttcatagttaataaagcattaaaagtgcaattactgtcaaaaaatctttcagaaaatagaagtctttaaagtgaagaatatttattctgaagacagccattacaaatataaagggggttgtagtgcctttacttgtgtcacagatcttagtgcacacatgtagt

SEQ ID NO: 331283 - DNA, 1702 bp, Homo sapiens
ctcgctgcagcgggagctccaggtttatcctcagtgttctgtgtcctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaacccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagccttt

SEQ ID NO: 331284 - DNA, 620 bp, Homo sapiens
cacgctcggctaggttacgctggttctgatagtgtcttggtggaacgttgctgaatgaaggcaagatctccagttccctgttggtccagcactgggcctagggaccaggatagtggtggggcctcaggagtctcatccagtaggaggcagggggctagagataggctgtaagcttgggaaatgactacatggaaaaagtattcaccaaggaggggtaattcactgcctgtgtgatgagtagcacatgggaagttctgacattcatgcccgtaaagggctgcttcctcttcagcaggaaatgctgatgggaaggcccagagagagcagccacaggcaaagggcacagggctggtggcaaaataaccatagctcatccaggctgagtctcctagaccaaggtacctgagcacttcccttcctcatgctccactcagcaactctgaggaccaaacctgggctgacagcttggagatggtcccagggctgtcccacagcccagactgagaccagggcatctgacccgctttgagggagggtactggctaacagggaaagacacagacacatcctggattgggccatctgccactggaatggcagcccagagtctaggttctaga

SEQ ID NO: 331285 - DNA, 204 bp, Homo sapiens
tcataaggatagaatgcagtaaggttgggacatttgaaagcaggttcccaggaggttcagcttagtagcattcacaccctcacttctggaaaagtcaatgtttccttcttcttctttctcttcccgagctgtgagttcagggtttcccttccctcccagtggatttcctaggccaggaagatgtcatgcctccagagccctcca

SEQ ID NO: 331286 - DNA, 128 bp, Homo sapiens
caggaatttgacaggtaccagtctgatgtgatccacgtgggctagggtcataaaatatctacatgggagccatggagaatggtcgatgtgacctcacattggtgacaaaattccttttactgtctggc

SEQ ID NO: 331287 - DNA, 243 bp, Homo sapiens
  misc_feature (19)..(19): n is a, c, g, or t
ctagacgatcccatcgtantatgtaccatgatttataattatttaaattacttattataaaataagacacagaagttgctgtgggttttctggcatgagccctttggattctgtgttttagcattcatgatcattctctgggccactttattcttacacaacctttttttttttttttttttaaaatacttcaagttctagggtacctgtgcacaacgcgcaggttggttacattatgttaca

SEQ ID NO: 331288 - DNA, 483 bp, Homo sapiens
agggattttcgtaaattccctgagccagtaagtctcccggcctgtgatgagagctgtgggtctgtggggctcacctggtgtgctccggtggctgccaactgtcttagcctttgtgtgccacctgcacagagtctccaggtcagtcagctgggaggttttcctgggcctgtgcgcagtcatctccagacatacgctagagcctttcagagccccatggacatctccagcttttccttcttgggttcttggccagcctcttgtttgcccaactagtgccccagcctctggcagctgcagggtgaaacagttgccactggttccttttgacaaaagccctcaggaactgggctgttttcactgagtgagatcaaataaagacaaatcctgccatgaggcttttccagagggtggccaggtaaacccaacagtgacagttctctgggcctggggccttgaggacccgttctccattgagtggctacc

SEQ ID NO: 331289 - DNA, 490 bp, Homo sapiens
acatatgtttttatgtacttggaccagacaataaataatgaatataatacagtcataaactgtatggaatattagaaggtatggtggaaaaattaatcagggtacaggtgggtttggtattggaagtgcattgttattctaactagtttgggcagactagaactctcagagaaggtgacatttgagcatttatttgaagggggggaatacattggtcctggggatatcacaaggaagagtgcttcagcaataggaacagccaatgcaaaggtttctgatgtcctatatgttctatatttgctccacatatgtgccgtatgtgttcccgggtagaagtgatggtggtgtccatgaatgttcttctctgattgcttctattttctcagtgaaataataagcaggattgttagctgagagtgaggatggaaaagggaaaggtggtttgaaggaagataagagtgggtgatacagtcctctatcagtatgggag

SEQ ID NO: 331290 - DNA, 432 bp, Homo sapiens
gggcctccggctgtaccccctgaatactgccaaggtcgcagctttctggcaggcagagctgactgggctgagcagtgccaccacggctggggctgctgggatgtcttgggaggagggttctattgccgtggcgtttgtttaccaaaggcccttccagagggagatctgcagaggaaaagagaggctgccttctcggcttggctctgagctgttcctacttgagacctgtgggtgctagaggaaaggccacacctcatgcctgtggacagacaggcctgggggctggatgcagtcacctttcaggctccatgcgggtctggcttctcttatcccttgcgtccatgcgtgggaagccctgagccctcccacgggacaggaggagccgtgaagggaggaagccccgacttcggggtgatcgtgcgtaagttccca

SEQ ID NO: 331291 - DNA, 523 bp, Homo sapiens
ctttactggggtgtaacaaacacacgataaactgcgcatattccagtgttcatgtggatgagtttggacatatgcacacacttccgaaaccaccagcacaatcaagacagcagacatatccatcgcccccaagggtgtccttgtgtctttttgtcattcatccctcccggccgccccatccacactcccatcgcctgccgactgtggctgatctgctttctgcggctgtggattagtttgcgttctctacaattttctgaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttgctccatgagggcaggggattttgtctgtttcattcacaatgtgttcccagagctc

SEQ ID NO: 331292 - DNA, 394 bp, Homo sapiens
atttcagagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaaggcaagtattttaaaac

SEQ ID NO: 331293 - DNA, 468 bp, Homo sapiens
aggtgtgagccaccacacccggcctaaattttatttttatacttcacatttagatccttgttttgcttggaattggttttcagtttgtctgtggtggtaacataggagtcaagtttatttttcttcttctgtatggatactaatgaacccaggatgtatactgaaaaagccatccttttccactgcactgtcataccacctttgtcataaatcagtctgtggtgtgacacaggagtcaaatgtatttttcttctgtatggatagctaatgaacccaggatgtatattgaagaagccatcctttctcctgctgcactgtaatataccacctttgtcataaatcagaggttgtgtgaacctgttcagaattttattctgttctgttggcctatttgtggcatgtacttttttcttttcttttttttttttaaatagcctaattgagttataattcacatgccataaaatt

SEQ ID NO: 331294 - DNA, 411 bp, Homo sapiens
cacaagataagaaagtcacagacaaatatccataatgaacatagatgaaaaaattctaaacaaaattttaacagtgaatccaacagcgtataagaagtacagtgcatcatgacccagtggagcttaatcaaggttaatttagaatttgaaagtcaaccaatgtaacttgtgacaaataaattaaaaagaaagaaaatccagccaggcacggtggctcatgcctgtaatcccagcactttgggaggcagaggcagacagatcacttgaggtcagaaattgaaggccagcctggccaacatggtgaaaccccatctctactaaaaatacaaaaattagccaggcatgctggcagccacccataatcccagctacttgagaggctgaaggcaggagaattgcttgaacttggga

SEQ ID NO: 331295 - DNA, 613 bp, Homo sapiens
catccagcccagtgcctggcatatggcaggtaacccaataaaagtaattaatgtaatttaaaaaaatttaactgaagtagtaatgacatttgaactacttagtctatatactatataagccacacagttaaagtatgtgatctttcatacctctatgtagcatcaaggaatactatttttctggataaaaagagtataactatgcaaaaaacaggggagaaatgcagtcttcttccctttctgtgtaaaacattggtttttctcttttccaagggacatgaataactattgatggttggtataacttcattttgggttgcttgctaactttaaaagttacagattaggcaaagcataaattttctgcctataacatggtcatagaatggatgtcttcatatgtgccatatttggccagcatagttttttagagtactctgggtaggacttgtattttccagtttactataattaacatgggtaaaatgtaggaattaatatatatgtaaatacttaaaacaatgactggcatatatggtaagttttatatacttgtttattcttatttatcattctctattgctttatgcttagcctcttcataactagatgt

SEQ ID NO: 331296 - DNA, 3750 bp, Homo sapiens
  misc_feature (528)..(528): n is a, c, g, or t
cagacagagacagacaggatggacttcctccggctatacctccctgggctgcaccaggccttgaggggggcactggattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagccaaaacgagggggctggaaggctgagagggcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagangagaggctgagaagctgggaacaggaggaggaggaggaagaggtcagggcaagagagccagggatggccagaggggcggagtcagagtggacctggcatggggagacggaggggaaggctggtgctgttgggccaaaggcggcaggggacaaccgggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatatcctcaggcggggaggctgggacagcctcaggaggggaggaggccgggacagcctcaggaggggacgaggcctggacaacctcaggcaaagaggaggctgacctgctgggagtcagacagactcaatatggagcagttccaggagaaaggctcctagaggctactggaaaagtctgggtcctagaggaggagggggatgaggagagagaggctgaggtgagccctttccccaaacaggcccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccagggacctgagctgatggggggtgcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccaggacgcgggatgtggaactgaggagggagaggcgtctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcga

SEQ ID NO: 331297 - DNA, 352 bp, Homo sapiens
cttacataaagggcaacatattctgcctttgggaaatgaaacgatgcccctgacccaccatccataaaggatgtactatgagacatgagtgcaaaggacaatcctgacatgtcctaacatgcaaccgacgtttacccagggaccaaaggaatggatgtaatttcttgagctaaactgcccaaatgcttgtatatagggtcctttagaagtctctctatgtggccgggtgtggtggttcaagcctgtaatcctagcactttgggaggttgaggctggtggatcacctgaggtcaggagttcaagaccagcctgaccaacatggcaaaacctcgtctcaactaaaaatacaaaa

SEQ ID NO: 331298 - DNA, 379 bp, Homo sapiens
acccctactagaatcccagtaacattttttgcagaattagaaaactctgtcctaaatctgacctgacaggcacttattaatgactgccacaacagaaacactgtgaaaaagatgcaaccatgaaaaggtggaaagttttgatgacatagaaaatagcaatcagcctttctcacatcccaaagccttcaaatatatatgagtgcagcatggccagtatggaattcaccgaaaactaatcaccaagctagaaatgtggtgagagaaaaaaaagggcaagaatatatttggcttatcacttcccacttttgtctactaatctgatgctgaaaagaaattctcactgaagcattttagattttgaatctttcagatttgggat

SEQ ID NO: 331299 - DNA, 949 bp, Homo sapiens
atcttccccacagcgcttgtccctctagaaatgactagctcagtactcagtaatgaagtactggtgcttcatcttccctcttacaaataaagcaatgtgaggggaaagaccagacctttagaccctggcctctcccaaccattgtatgtgggctgcccagggggcatgagagtggctttctgcagcagaggcgttgggaggctctgctgagagggtggctgctcacacaccgccaggatctggggcagaggctgagggaggacctgggcggccacagcagctctcaaacccaagcgtgcatcagaatcttccagtgggtttgttcaggcacagattgctgggcccacttcagagctgctgatccagtaggtctaggatttctagcacgttctcaggtgattctgtggctactggtccctagaccacactttgaggaccgcagagaggtgcatcagcatggccatgacagtgaacttagtgaatagctgcagggtgggtccagtgacggacttcttagaagctatgccagtgacccccgtgagagaagacaggactctgaaacaggctccagcagtggggctggagaacagaaaggaagcacccaagacacatgcgacagtggaatcagtgcgctggtgggaggcgaggaaggagttcgagcagcgggaaggatggaagtgctttggaccaagatgggcactgggtggaggaaggaataatgtgttccctttgggacctgctgctgtgaggggctaaggagacctccaggtggagatgctaaggaggcagtgggaaatgcttttaaaactcaggagagcagctggcgacgggtacagatgctggggtcttctggataggggtgtaagctgcctcagtggggctgaatgagagtccttaagcggagagagtggtgatgtgcttggaagccaagaggctctcactcgtaggg

SEQ ID NO: 331300 - DNA, 447 bp, Homo sapiens
ctattcttatatcagacaaaacaaactttaaagcaacaatggttaaaacagacaaagaggaacattatataatggtaaaaggccttgtccaacaggaaaatatcaaaatcctaaacatatatgcacctaacactggagctcaccaatttacgaaacaattactaacagacctaagaaatgagacagacagcaacacaataatagtgggggacttcaatactccactgacagcactagacagatcatcaagacagaaagtcaacaaggaaacaatcgatttaaactataccttggaacaaatggacttaacagatatatacagaacatttcatccaacaactgcagaatatacttctattcaacagcacatggaactttctccaagatagaccatatgataggccataaaatgagcctcaataaatttaagaaaattgaaattatatc

SEQ ID NO: 331301 - DNA, 600 bp, Homo sapiens
gattggtgtatttacaatcccttagctagacataaatgttctccgagtaccccgccagagtagctagatagagagtgtggattggtgcattcacaaaccctgagctagacacagggtgctgactggtgtgtttacaaaccttgagcacgctgtcacctctcaatcccactcaaactgtgtttacagagcatcagagaaaaaaagacaacctgtattcgccctgggaaaaactaatgtaagaaatattttctctttcaataattttttctgatgcagtaagaaattcccataaaatgcttaagattttacttccagtcttagaaatatgtgaacctataaatatatttgagaccaccaaattaattcaagacatctttcaagaaactattgaactgataaaagatatgatatgtgatgaatactcctgccctcaaggtggctaaaagctggtaaagacagacatataactgaatattgcatgccaaaatatgcaaacacatgtgcatatgaatgtgcacacacacacaactgcagtactgtgaaatcagtggcaacatagagattttcatgggggaacaactcataccattagtgacagta

SEQ ID NO: 331302 - DNA, 4484 bp, Homo sapiens
  misc_feature (2840)..(2840): n is a, c, g, or t
tcagcggcagcagccgccgccgagatgtcccggcgaaagcaaagcaaaccccggcagatcaaacggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaacccngcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaaagaaaatagtcacaatacagaaaagcattttagaaatagcttcaaaagcacttgtgtatcttgattttttcttatatgctgttgcagatatatgtatatgctaaaatataacttgcaaagatgttctaaatacacatgctataagttcgccttaagatttcaattcttggataatcaggctctgtttgcactttatattttagcagatacagtctcttagtcactaggctttgcatttgtatgtagctgtatgtttccgtccattttcttaatcctgaacctgtatgttaaatgaagatggcaatttttttcttgtatagtacttgtattttctttcgctgatgcagctctgtctcaatttttaaacctttgctgttaaatgcaatactttataaagaatgaacaaaattactggaagcagtattgtaagtaatgaggtagtattaatcagttttatcttttgaaaggcacagtctaaatcgaaaccctaaactcaatgctgcaagtatgaatttaattcatatataagatctatttaaatataagagtagcaatactgcacctggtgatcacaaagataatgttctacttctgatagaaataatttctcaacaaatgttgttactatgcatgtatatggatggaataaaattccagattgttggagaagtt

SEQ ID NO: 331303 - DNA, 817 bp, Homo sapiens
taaaagtcgagtcctatgctgtagaacaacaccaaagactgttactcatctgattgcccaattaagaacctgagagcggagtctgagaaaaattgaactaaatgctgctttacccacagttggtttcaaatggacagcagcaaatgtgtctcttgtgtttttacctgcagaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggtaaatgccccttttgtttcttctgttgctccagaagactctgttatttttataaatatatatgcattacatgtatacgtctatatctgtctatctgtagctatctataacatcaaaatcaaactttctgggtcaaccagtgtgatcttatgccacttatactcagcatatgttactcaaaggacttgggtctgaattcttttcttacaaattcagaggccaaatcattctatttgttctcaactgaggttttaaaaaagcacattattttaaaaagaaaatctcaataccctttgaatattgccatttattgctttagtgtcaagcaatctttggaaactgatcatagtgtttcctatatggtagggaagaaataataggtacataaatataagtgtgtgctgaattgaaataaagctact

SEQ ID NO: 331304 - DNA, 1705 bp, Homo sapiens
gattggtgtatttacaatcccttagctagacataaatgttctccgagtaccccgccagagtagctagatagagagtgtggattggtgcattcacaaaccctgagctagacacagggtgctgactggtgtgtttacaaaccttgagcaagatacagagtgccaattgctgtatttacaatcccttagctagacataaaggttctccaagtccccaccagactcaggagcccagctggcttcacccagtggatcccgcattggggcgcaggtggagctgcctgccagtctcgtgctgtgcgcccgcactcctcagcccttgggtggtcgatgggactgggcgccgtagagcaggcggcagcgctcgtcggggaggctccggctgcgcaggagcccacagcgtgggggaggctcaggcatggtgggctgcaggtcccaagccctgccccgccgggaggcagctaaggcccggcgagaagtccggcacagcagctgctggcccaggtgctaagcccctcactgcctagggcgggcggggccggctggctggccgctctgagtgcagggcccgtggagcccacgcccacccggaactggcactgacccgcaagcgctgtgcgcagccgcggttcctgcccgcgcctctacttccacacctccccgcaagctgagggagccggctccggcctcggccagcccaggaaggggctccaccgtgcagcggcgggctgaagggctcctcaagtgccgccaaagtgggagcccaggcagaggaggactcgagaacgagcaagggctgcgagcgctgccaggcacgctgtcacctctcaatcccactcaaactgtgtttacagagcatcagagaaaaaaagacaacctgtattcgccctgggaaaaactaatggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaatagtaagtgctcagtgctgtgtagcccagctttagaggtgatgggaatttatgggagaaaaaaatgtctactgacaagaaaccaggaacagacctttttccttcagtg

SEQ ID NO: 331305 - DNA, 313 bp, Homo sapiens
tgcacattgtgcacatgtaccctaaaacttaaagtataataataataaaaaaagactcagagacatattatctatgtaccacgaaaacttaagaatgacaggaattccaaaagtttgacaattttgtcacagcatttaatctcctattcactagaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagag

SEQ ID NO: 331306 - DNA, 988 bp, Homo sapiens
cctagttttagaagtttcaatagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagatggtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggaga

SEQ ID NO: 331307 - DNA, 333 bp, Homo sapiens
atgggatgatagtgctgaggggaagttgataacgaatcctacttctgctctggatactcaggtagatggcaaagccatccaccaaggtgggtaacacacgagacggaagaggcagaaggaggggcaggtgtgaaggtcaagtcagcttgaacttgtgaatgtgagacactttcatgcctttcaagtgcatatgttcagtaggtagtcaggaatatgaaaagtgaaaaagagaccaaggcaaaacagatcagctaaggaactgcccacatacagatgacagttgaggttgctcaagtggatgaaccttctagaagaattgcacagtgtgggatt

SEQ ID NO: 331308 - DNA, 365 bp, Homo sapiens
ggtaagcactgaggagacagtaatgaacaagagctcctattcagacacacattccattcagggctcatagtctaatgaggaaggcagacattaatcagataatcacaaaaggaaatggacaagtataaattctgattattgctgtgtagtgaaagacaggatgagttgtaatcggggaacctggtgtagatgggggattaagaaaggtttcctttagcaaatggcatttgaactgaggcctgaaatgagtgtcagctgaggaaaaaggtagttgactccaggccgagaaaatagcacttgctaaagcccttatgcggggaattggttggtgtgttttagaaaaggaaagaagaaatataaaatgc

SEQ ID NO: 331309 - DNA, 2336 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331310 - DNA, 902 bp, Homo sapiens
  misc_feature (740)..(740): n is a, c, g, or t
  misc_feature (812)..(812): n is a, c, g, or t
  misc_feature (860)..(860): n is a, c, g, or t
  misc_feature (867)..(867): n is a, c, g, or t
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggnttaccgaactggaagacacgttttgggccaaaacccaaacttattgaattagaagccaaacttggcttggtncaagaaccaacatgaattgggagccgccttgtttcccaagaacttgtngggaatngggcatttttcaaccccggggttaaccaaatgaac

SEQ ID NO: 331311 - DNA, 787 bp, Homo sapiens
  misc_feature (710)..(710): n is a, c, g, or t
  misc_feature (729)..(729): n is a, c, g, or t
  misc_feature (758)..(758): n is a, c, g, or t
  misc_feature (780)..(780): n is a, c, g, or t
  misc_feature (784)..(784): n is a, c, g, or t
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgtttcgttctggccccaagcccttgaattgcccccctttccccgaaaggaaagggttcaaaagcttgcccccgggggaaaaattgcttgccnaaaaggaaatttggggttnttttttgaaacgaaagcccccaaaagggnaacccaaaaacccggttggggntttnggg

SEQ ID NO: 331312 - DNA, 666 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccggtaagacccgcagcccccaccgctaggtgtccggccgcctcctccctcacgcccacccgcccgctggaaaaagaaaccgctcggactgagtttctttctccagctgctgccagcccgccccctgcagcccagatcccaactcgcatccctgacgctctggatgtgagagtgccccaatg

SEQ ID NO: 331313 - DNA, 348 bp, Homo sapiens
  misc_feature (20)..(20): n is a, c, g, or t
  misc_feature (303)..(303): n is a, c, g, or t
tactactactaaattcgcgnccgcgtcgacggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagaanaaatatacactttattttcaactagaagtcgacgcggccgcgaat

SEQ ID NO: 331314 - DNA, 254 bp, Homo sapiens
ataagagtatgctattgaaactatctaaaactggaccactctgagtctcccccaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctactgacacttctaaaactaggcctcagttgagaagattcaatagcaaaagaaaaaaa

SEQ ID NO: 331315 - DNA, 2724 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaaggtacatgttctgctcctattaactatttttcacaggaaaaacagtggataggacccaacttagggctcttgccacgcttgttagtataagcccgttatctccaaaactatctaaccattgagctgttttgctggaatgagagcttgtgtaatagcaaccaccagttttccactacgaaatcttccacagggttagttaattcaagacattccaagagaggctctggctatttttggacatagcaaatgagactcaaacttcctcccctcaaaatataaacagaagtcagacaacagaagactaaaacacagagggttgaagaaagccactcctcttgtagagtcgctgatttttttttttcctctctcttttcccttgtcttccttagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331316 - DNA, 2406 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaaggtacatgttctgctcctattaactatttttcacaggaaaaacagtggataggacccaacttagggctcttgccacgcttgttagtataagccctcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331317 - DNA, 1898 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgacccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331318 - DNA, 2266 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctagatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331319 - DNA, 1013 bp, Homo sapiens
tgatagactatttgtttgacatggcacaatgttttgaatgggtgggaatcttgttcccccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331320 - DNA, 2770 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaaaaaaaaaacaaaaaaaacaaaaaaaaaaaaaaaaacaccacacaacacaaaaaagaaaacacaagaagacacaacagcagaacaaacacaacacggcagacaacccaacgcaaagagccgcgggcgggcgcgagccgcgcacagtgcaccccgcgcgcggcgaggaccccgcgctcggcgcgcaccacgcggcagcgccacacacgcgcgacgccccgcatacaacataggggtcggcggcctgtcaccgtaatggtacgcggccggaaccggccacgcgcgagggccgcacaaaaagcaagccggagcagcgatcgcacggccgcaaccgcaccacacgtgcacactagacgcgtcacagcccaccacgcacgaacaaacaagccccatacacaccgacgcgcgcgcgcccaacaccaaccactcacagccac

SEQ ID NO: 331321 - DNA, 2376 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagcttcccccccagtagtatattttttgtattttaaaaaaaaaaaaggtttgtgccgaatataagagtaatcc

SEQ ID NO: 331322 - DNA, 2259 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttgtctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331323 - DNA, 2176 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgtcaagctgaagggtactttttgggaatcggccgatagaagagacccggcaccgatgtttgccgggggagcacacgccggcagcgatcaaggagaaggggccccttgagagggtctaaggggcttatggccaccggaagtctaaagggccatggagcaccaggtccaat

SEQ ID NO: 331324 - DNA, 793 bp, Homo sapiens
  misc_feature (776)..(776): n is a, c, g, or t
  misc_feature (785)..(785): n is a, c, g, or t
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgggtggctgcttgggtacatgaaaacttgcaacacttataagcatgtgcaacaaatgangttcaactngatggatt

SEQ ID NO: 331325 - DNA, 858 bp, Homo sapiens
  misc_feature (20)..(20): n is a, c, g, or t
tactactactaaattcgcgnccgcgtcgactttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaaaaaaaaaacaaaaaaaacaaaaaaaaaaaaaaaaacaccacacaacacaaaaaagaaaacacaagaagacacaacagcagaacaaacacaacacggcagacaacccaacgcaaagagccgcgggcgggcgcgagccgcgcacagtgcaccccgcgcgcggcgaggaccccgcgctcggcgcgcaccacgcggcagcgccacacacgcgcgacgccccgcatacaacataggggtcggcggcctgtcaccgtaatggtacgcggccggaaccggccacgcgcgagggccgcacaaaaagcaagccggagcagcgatcgcacggccgcaaccgcaccacacgtgcacactagacgcgtcacagcccaccacgcacgaacaaacaagccccatacacaccgacgcgcgcgcgcccaacaccaaccactcacagccac

SEQ ID NO: 331326 - DNA, 2467 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcgggtgagtcgagtcttcctctaagtcagggtcgtgattctctcccagggagggagtcctaactgtgccgaccgaacgggggaaataccttatccaggcgttttacatggtgtttgtgtgctctgctctcgcagcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331327 - DNA, 2238 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331328 - DNA, 2279 bp, Homo sapiens
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 331329 - DNA, 2378 bp, Homo sapiens
  misc_feature (2351)..(2351): n is a, c, g, or t
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaaaaaaaaaaaaaaaanaacaaaatgtggcgcggccctggcaca

SEQ ID NO: 331330 - DNA, 1539 bp, Homo sapiens
  misc_feature (1523)..(1523): n is a, c, g, or t
  misc_feature (1530)..(1530): n is a, c, g, or t
acaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggcttgggtgccgtgtnaatcctntagatcgac

SEQ ID NO: 331331 - DNA, 194 bp, Homo sapiens
catttttcagtcatgccttgaagttcgttcttctagcccattgcctagaatgtaaccccctccctccttttcacgttctttgtgcttgtccttcaaggccccagttaaatgtctgctacaagttggccccttcttttctgtgctcctgtaactctcctgtagcgcttttcaggtccggccgaagtgatcttcat

SEQ ID NO: 331332 - DNA, 255 bp, Homo sapiens
gcttacagtataagatccaaactgtgggcaaacaacgcacttcacaacgtggccaactctctggacctaacctcccacaaattcctttcaatccactgtaattctgccacactgaacattacattatgtccagctacagcaaaccatcttttgaccacatgcctttgctcatgctgttctctgaatagagcctccctcagagcctgttaaactcatccttcaaaactcaattcctaagggccggcgtggtagctc

SEQ ID NO: 331333 - DNA, 412 bp, Homo sapiens
tctcttggtatcacaatgtaacacaacaacaatctggcccacacacacacaacacacacacacagaagcagccacattttttcccgatatatgggctatttcagagtaacagtgaggacagacgccagaaggcgttttattctgccacagttcagaataaaatggtctctggttcactacagtctcttttctacatcttaggcaaataaagactttttttcacagaaagaaaggcaccaatgctgctgtactccagttaactactgatgctgtattttcatcacctgagactggaccaagagttgcatctcaaatgacagagtccccacaatcaaatctctttatccaactctcaaattgagttttgctttgcaattgttgacctatttaattgctttttctcttcctcaag

SEQ ID NO: 331334 - DNA, 3358 bp, Homo sapiens
tggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctgggattataggtgcgagccactgcgcccagcctcagttattttatttaacagtgtaagtacttagaaagtaagaaaattgctgatttagttttttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatgataagatgaaa

SEQ ID NO: 331335 - DNA, 1018 bp, Homo sapiens
  misc_feature (491)..(491): n is a, c, g, or t
agctgggactacaggtgcccgccaccacacccagctaatttttttgtacttttagtagagacggggtttcaccatgttagccaggatggtctcgatctcctgaccccgtgattcgcccacctagacctcccaaagtgctgggactacaagcttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctaactataattaagaagatacatattaaatggaaatatagtcgttctatgggggattatgcaaaaataaaaagaagataaagaaatacaaatagaaatgaaaagataaaaaaaaaaagataaaanaaaaagaatgaaagaaagaatatcaagaattataaaaaaaagaagaagaaaaagagaatcaggagaaaagatgtaggaataacaaataagaagaagataaattagaaaatatcagagatttaattagcgaaagatccatcttaagaaaatccggatcaaatagaaaaaaatatcaagtgaaaaaaatagctataaaaggaaacaattgcagaatatgctcacgactaacaagcaatgaagaaagcaaatgaggaatagataagagaaaaaaaacaaaatatgcagaggcataaatcttcaattcacatgaaacaccacacagagacaaccagggactaaaacaaagcaaaaaacaaacaacagaaatccaggaaacacaaaccagcagccagcccaaccacacaacaaaccaacgccccacacccccacctccaacgcccccgccaacccgcacaaacacacacctcaaagcacacgacgcaacacacaaaaaaaaagacacacaacaaaatcagaaaaaacaaaaa

SEQ ID NO: 331336 - DNA, 3495 bp, Homo sapiens
tggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctggggattacaggcatgcaccaccacgcccagctaatttttgtatttttagtagagacagggtttcaccatgttggccaggctggtcccgaactcctgacctcaggtgatccacccacctcggcctcccaaagtgcctgggattataggtgcgagccactgcgcccagcctcagttattttatttaacagtgtaagtacttagaaagtaagaaaattgctgatttagttttttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatgataagatgaaa

SEQ ID NO: 331337 - DNA, 3441 bp, Homo sapiens
tggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctggggattacaggcatgcaccaccacgcccagctaatttttgtatttttagtagagacagggtttcaccatgttggccaggctggtcccgaactcctgacctcaggtgatccacccacctcggcctcccaaagtgcctgggattataggtgcgagccactgcgcccagcctcagttattttatttaacagtgtaagtacttagaaagtaagaaaattgctgatttagttttttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatgataagatgaaa

SEQ ID NO: 331338 - DNA, 3354 bp, Homo sapiens
gcatctcgaggatctccctggatctagcctggctgccaagtgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctggggattacaggcatgcaccaccacgcccagctaatttttgtatttttagtagagacagggtttcaccatgttggccaggctggtcccgaactcctgacctcaggtgatccacccacctcggcctcccaaagtgcctgggattataggtgcgagccactgcgcccagcctcagttattttatttaacagtgtaagtacttagaaagtaagaaaattgctgatttagttttttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatgataagatgaaa

SEQ ID NO: 331339 - DNA, 2638 bp, Homo sapiens
ttgataaaaattacctgtttcgaaaggcatttttggcagctttttatcaaagttaatacattcttataattttaaaagtcatagagggctaaaagttcatgacagaaatgagcaattccctgtattccccaagtctgcttctcgaagtggactgtattccccaagtggctttttcttcagttattactctcatagttccaaataatagaggtatacagctctcttgattcttcagtttcagatattatctgttgatttttttattttgttaggtgagtaatttctttctcttatagccctcttattccctcagactttgaatacagtcatactactctctggaagagaagtatatgtattttgttgttgttgttatatgtagtaggatttaatgtattactaatacacatatgaaaactcactaaagtatccccagtagttagtaaattcctaattcaaatcaagtaatacagttctctgagaggctagcatctccatatcttccatcttttaaatacaattgatacttttactttaatcttgcttgttaaaattattctgttagctattacctggtgtaatagttcttgtttactgaaaaactgtcaacactccataaatctatttattctaaatttgggttttaggcatagttaagaaagtaattactgttactggaattcacctgataaaccatgtataacataattcattgcagaatcacattaaatatcaattaaacatgtattattcataaagttttttgttattagaaaaagaccttaaatgcttggcaaccaattctaataaaaattttttttctctttataggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctggggattacaggcatgcaccaccacgcccagctaatttttgtatttttagtagagacagggtttcaccatgttggccaggctggtcccgaactcctgacctcaggtgatccacccacctcggcctcccaaagtgcctgggattataggtgcgagccactgcgcccagcctcagttattttatttaacagtgtaagtacttagaaagtaagaaaattgctgatttagttttttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatgataagatgaaa

SEQ ID NO: 331340 - DNA, 406 bp, Homo sapiens
caagacactgtctcaaaaaacaaaaagagaagaagaaaaaaagtacattggacagtggttagtgctaaggaggaaaaaagcacaggagggtaatgttattaatgtttagagaggaggggtgaaatttgaggtagggtcgtcaggggagacgtcattgacttgtatgaagacctgaaggtagtgaggaaccagctgtatgaacacatgagaagagcattttaagttcttttggaaactcacttttagaataatcagtgttctctgtgttttatgttaacagaggctagtattactagcttgaaacaagctgccctggttaaagcgcctctcattccgactttgaacacaatcgttcagtatctagaccttactccaaatcaggaatacttgtttgaaaggatcaaag

SEQ ID NO: 331341 - DNA, 2283 bp, Homo sapiens
  misc_feature (1194)..(1194): n is a, c, g, or t
tggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataaggtaatgactctcttctcttgtctagtcacattattttagaattgagaggtatactaaaaatcatctaatgagtcaaaacttatcagtgagcaaactgagagttgatttgcccagaacacccatttaaaaaccgagaatagaacataatatcttaaacacaacatcttaaaatgaaagagaaaaaattagcatttacagagataacaaacttagtgcaccatctacgatctttcagctgtctttaaaacaagttgaaacaaggataattttttactttagttgcttttactcctgttttccctcttgctttccttcttcatgtgaggcctttgtatacctttttagagttttagtgtggtttatcatgttggagtgtcttctaagctaaaagctgagattgtcacatagtttctttttttttccaatgagtacaaatgattcttgaatatggacgctttccatggaatagtaggaaccttcatttccactcccacagtaatgtgaaattttgttctaatttttaggattaatagaaacaggattgacaaattgaaattttgactncttcttgaagcataaaactatttttttttttttttttttttttttttgagacagagtctcgctctgttgcctagactggagtgcagtggcgtgatctcagctcactgcaaactccgcctcccgggctcatgccattctcctgcctcagcctcccgagtagctgggactacaggcgtccaccaccgtgcccggctaattttttgtactttcagtagagacggggtttcgccatgttagccaggatggtctcgatctcctgaccttgcgatctgccctcctcgacctcccaaacatttacacatttctttgtaatgaaattccatactactggttatccaatattaaaattaattttggcaggtaatagaattttgaaaattttgtacaagttaaatttttatgagaaagtatatatgtagtgaaaattaataactcataggtaaatgtgacttttaaaaataatttttcacaagatgatactatatgatccttatagaaaattggaaaagtaaaacagaaggaaaattattatagtcctgccacacaaaaataatctgtttaatggctatttaatactcatctaatggatataccataatttactcttgaatgtttaagtcattttcatttataaaaaaactttttaatgtatactaaatagccctgtacataaaattattgataaatttgggatgggagtgtcgatccaaaagaattgtaccaatttacattgtcacagaaatgtagaagagtgtttgttttaccacactgttgaccatcaagttaattttttaaaaaaataaatctctgctaataagaaacatgacaatagtctatcgtaacttttaacatacatttatttcaaagccgcatagctaaatcaggaagttctcgtgctttactcgcttgtcttttgggtctgtatcctctgattttttttcttgggttgctgtttaattatagagtttaatatatatatatatagagagagagaaactttaaatgtttaatagtcctatctgtttatctccttgtggtttgctctgtttttaaatttagaaattttcttactttcagaattgattcccc

SEQ ID NO: 331342 - DNA, 3524 bp, Homo sapiens
tggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagcttttaaaaatttcaccttgttgccacagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctggggattacaggcatgcaccaccacgcccagctaatttttgtatttttagtagagacagggtttcaccatgttggccaggctggtcccgaactcctgacctcaggtgatccacccacctcggcctcccaaagtgcctgggattataggtgcgagccactgcgcccagcctcagttattttatttaacagtgtaagtacttagaaagtaagaaaattgctgatttagttttttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatgataagatgaaa

SEQ ID NO: 331343 - DNA, 1739 bp, Homo sapiens
tggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctgtaagcccctagattctttcattcatttatttatttactgttgattgactgacacagggtcttactctgtcacccaggctgtagtgcagtggcacagtcacgtctcactgcagctttgatctcccagggctcaagtgctcctcccagctcagcctcccaagtagctgggactaggcctgaaccaccacacccagctaatttttttaattttttgtagagatggggtctcacttttttgcccaggctggtcttgaagtcctgggttcaagtgatccccctgcctcagcttcccaaagtgctgggtttacagacacgagctactgtgcctgacccttaga

SEQ ID NO: 331344 - DNA, 648 bp, Homo sapiens
gtaaaatgtggataatacggccgggcgcggtggttcatgcctgtaatcccagcactttgggagaccgaggcgggtggattgcctgaggtcaggagttcgagaccagtctggccaacatggtgaaaccccgtctctactaaaaaatacaaaataaatttgccaggcatggtggcatgcgactgtaatcccagctactcaggaggctgaggcaggggaattgcttgaaccagggaggtggaggttgcagtgagctgagatcgcaccactgcactccagcctggatggcagagcgagactccgtctcaaaaatacataaataaataaaataaataaaataaaatggggagaataacagtatctacattttagagttattgtaaggattaggtaagttaatacatgtaaaagtgcttaggacaatgcctcgtaagcagaggcaataaatgctaatattaccatcatcggaggcatttaggcaggactcatgacaggatgacagtcacatttggtagacaccatcaaccaatgatctctaatttgcggcccccaagaagcaatggggttctgtgggctacatctggaatttgaaatgtctcatggaaatcatgttcttaccctggagaagggtggctgcttaggtgctactta

SEQ ID NO: 331345 - DNA, 211 bp, Homo sapiens
acaaccttttaatatttctgccatcagcacctattgtctggtgctgtgctagatgcccagaacgcaaaggcgagagaggcgtcccagtctgaaagtccaatgggcctagggctattggctgttgactgctctgctgatgacttcctctctctggtggagaagctcaaggagggtattgcaggcaagggagacggtgggagcagaggcttgg

SEQ ID NO: 331346 - DNA, 1361 bp, Homo sapiens
tctgtcatcgaggctggagtgcaatggtgcaatcttggctcactgcaacctccaccttccagactcaagtgattatcgtgcctcagccttctgagtagctgggatcacaggcgtgtgccaccattcccggctaatttttgtatttttagtagagacaggtttttgccacgttggccagtctggtctcaagctcctgacctcaagtgatccacatgccttggttgaccaaattgctgggattacaggcatgagccaatatgaccagctcaaacatcttctttttaaatgtcagaagcatgtatagtgattatttcttattttttcccccttgatccatctcaccagatgtttgttgattttataagaattttcaaactaccagcttctggctttgttgaacttggatttctgtttcactaattttctttctcctgtctttgtacttactttgttgctctttttctaagttttaaagatggatgccaatctcaggcttcttttcgtgtgtgtatgtgcgtatgtccataaattctcttctaattacagtgtaagccgcatcccacaagttttgatagtcacagaactgtatcgtcacactattttttaatttcagtaagttcttcactgatccctgtgtaatttagaaatgtttcataatttccctacattggaggggaagatagttttgtttttattattaatttctagctgtattgagctcttgtcagagaatatggtttattttagtcgtttgaaatttaagatctgcttaatggcaaaatgtatggtcagtttttgtaaatgttgccagtaagcttgcgaatcatatgtactctagttttgaaatccattgctcagtggatgttcattaggccaatttgtataatcatgttgtacaaatctattctattcttaactgttttttgttttaaaggtgtggggtcttactatgttgcccgggctggactcaaattcctcagcctcccaagtatctagaactacaggcacgtgcagcttggtttaaaaaaaaaaaaaaaaatcagtgagaagaggatttgttgatctccccgttaggattatgggtttgtctgttcctccttctcagcttatgctgtatatattttggggctgtgttattaggtgcatccaagtgtatagttgttatagttaccatgtgagctcaaccttggatctttacatagagattctctgtatttagtaatgttttgttcttaaaatctgcttccatctaacattaatataaatgtaccagctttattttatatgtatgtttcttggactttgtctttatgtattacaagaaattgtgataaagacctcatttaactggattgtgaaag

SEQ ID NO: 331347 - DNA, 213 bp, Homo sapiens
aaagtttgattcgtatggtaacatatgtgtttctaccagattgggaatttgttgagggcaggaactgtctattcatttatttcttcattcatgctatttgcaggcactaagctagggaccagggctctcactgtctggctgggagataaacaggtgaacttaccagtattgcgtagaaggacaattgctgtgatagaggacaaatgcaacgct

SEQ ID NO: 331348 - DNA, 446 bp, Homo sapiens
tgcagggaacggtcagaccggactcgggggaggcacggctgccagagctgagtgctgaggggcaagaaggaatccaccagacttaagtgcacaggacacagaagtgatcaaagggcccaaggccagaagaatttgacaaaggatcttgcaaatgaacaaataagaaatctttgctattaacgatagaggggtttgtctgctgctatgcattttcttgaactctctctctggaatctaactcagcgctcacttgctgggtgtctgcagtatgaaagcacagcacaggcagcagggagaaaggtctgctgtcacacacacagccagcctcgtccttcagtgtccaccccagatgccaccatctgatcattcagcaacaggatctcgagtccctggggcacccgcatgccagcaagcatgcccaagctggagggtgccccttctgacct

SEQ ID NO: 331349 - DNA, 5747 bp, Homo sapiens
  misc_feature (1133)..(1133): n is a, c, g, or t
cggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacantgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331350 - DNA, 2322 bp, Homo sapiens
gggggttaaaaagaaaaaaaaaaaaaaaaaaaaaaaaaaaaaaaaaaaagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccagg

SEQ ID NO: 331351 - DNA, 892 bp, Homo sapiens
  misc_feature (7)..(7): n is a, c, g, or t
  misc_feature (10)..(11): n is a, c, g, or t
  misc_feature (19)..(19): n is a, c, g, or t
  misc_feature (754)..(754): n is a, c, g, or t
agggatnatnnaaaaaacntaggctaggtacgaggctgggtgatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactgagaacggcgccggatccaagctgacgtgtcaggntgagccagagtggacccagagcactgaacaggaggccactgtggccaggcaccccaaagggacctggggcacacaagggggtctgggtgccccagcgggaaaggggcggccgggaggcactgggtatgccccaggccg

SEQ ID NO: 331352 - DNA, 494 bp, Homo sapiens
cccgagtggggcccagaaagcagggtacctggcagcccccgccagtgtgtgtgggtgaaatgatcggaccgctgcctccccaccccactgcaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331353 - DNA, 6699 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgcacagctactgggagggcagccggggacacctgagccgcccgctgtgcccagatccctcaggctgcctgccatcagaactgctgcccggggcttcccctacctcagacagaccctccctgggaggatcagtggggagtgccacctctgcccccagtggctgtggcacgtggcaggggcccctgaagctcagcgagggtcagggcctgggagggtatcattgctggaagaacaggatggggctcaggccagccctagtcgccggggcccacactaaccccccacttatgaattcctcccactcccaactcacaggggatttcccgagaggggacctgccaaagacctcctccaggcctcccatgctttccgggaagtgaagcttctccctctctggggcaggctctgaagcctcccgatgcacccagagcaaccggggggctgcaccagccactcgcctccccagcacggccaggttcccggggctggaggtcccccccaggtcctgggaaccaacctgcagaacacacacagggtcccctggagaggacgcggggacttccagggcccgactcctgtgagtcacagccccgcagctgctgc

SEQ ID NO: 331354 - DNA, 7136 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccgctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331355 - DNA, 5751 bp, Homo sapiens
  misc_feature (1133)..(1133): n is a, c, g, or t
cggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacantgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331356 - DNA, 3560 bp, Homo sapiens
  misc_feature (7)..(7): n is a, c, g, or t
  misc_feature (10)..(11): n is a, c, g, or t
  misc_feature (19)..(19): n is a, c, g, or t
agggatnatnnaaaaaacntaggctaggtacgaggctgggtgatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331357 - DNA, 7604 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgcacagctactgggagggcagccggggacacctgagccgcccgctgtgcccagatccctcaggctgcctgccatcagaactgctgcccggggcttcccctacctcagacagaccctccctgggaggatcagtggggagtgccacctctgcccccagtggctgtggcacgtggcaggggcccctgaagctcagcgagggtcagggcctgggagggtatcattgctggaagaacaggatggggctcaggccagccctagtcgccggggcccacactaaccccccacttatgaattcctcccactcccaactcacaggggatttcccgagaggggacctgccaaagacctcctccaggcctcccatgctttccgggaagtgaagcttctccctctctggggcaggctctgaagcctcccgatgcacccagagcaaccggggggctgcaccagccactcgcctccccagcacggccaggttcccggggctggaggtcccccccaggtcctgggaaccaacctgcagaacacacacagggtcccctggagaggacgcggggacttccagggcccgactcctgtgagtcacagccccgcagctgctgc

SEQ ID NO: 331358 - DNA, 6529 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgcacagctactgggagggcagccggggacacctgagccgcccgctgtgcccagatccctcaggctgcctgccatcagaactgctgcccggggcttcccctacctcagacagaccctccctgggaggatcagtggggagtgccacctctgcccccagtggctgtggcacgtggcaggggcccctgaagctcagcgagggtcagggcctgggagggtatcattgctggaagaacaggatggggctcaggccagccctagtcgccggggcccacactaaccccccacttatgaattcctcccactcccaactcacaggggatttcccgagaggggacctgccaaagacctcctccaggcctcccatgctttccgggaagtgaagcttctccctctctggggcaggctctgaagcctcccgatgcacccagagcaaccggggggctgcaccagccactcgcctccccagcacggccaggttcccggggctggaggtcccccccaggtcctgggaaccaacctgcagaacacacacagggtcccctggagaggacgcggggacttccagggcccgactcctgtgagtcacagccccgcagctgctgc

SEQ ID NO: 331359 - DNA, 6505 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagtttggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331360 - DNA, 4318 bp, Homo sapiens
  misc_feature (4180)..(4180): n is a, c, g, or t
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactgagaacggcgccggatccaagctgacgtgtcaggntgagccagagtggacccagagcactgaacaggaggccactgtggccaggcaccccaaagggacctggggcacacaagggggtctgggtgccccagcgggaaaggggcggccgggaggcactgggtatgccccaggccg

SEQ ID NO: 331361 - DNA, 1938 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccgctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccgg

SEQ ID NO: 331362 - DNA, 507 bp, Homo sapiens
gacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtg

SEQ ID NO: 331363 - DNA, 419 bp, Homo sapiens
aggttgctggtcccagccttgcaccctgagctaggacaccagttcccctgaccctgttcttccctcctggctgcaggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctcca

SEQ ID NO: 331364 - DNA, 5276 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccagg

SEQ ID NO: 331365 - DNA, 2592 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccgctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 331366 - DNA, 458 bp, Homo sapiens
tcctttggctgctgctctaagtagccgctggtggatgactcagcttctgccagccctcgggtgcctggaggatgagggactgcacacagtgctcacccgcgttggctcctgagcccctgcagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttac

SEQ ID NO: 331367 - DNA, 6986 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331368 - DNA, 5605 bp, Homo sapiens
aactggagaccgcaagaggagcaggtttttatctgaggttatcctagtcatttttgagacagggtgtcactctgtcacccaggcagcggttcaacagcgccatctctgctcactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331369 - DNA, 3850 bp, Homo sapiens
ggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331370 - DNA, 5911 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcat

SEQ ID NO: 331371 - DNA, 5499 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactgggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccagg

SEQ ID NO: 331372 - DNA, 3519 bp, Homo sapiens
ccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggagg

SEQ ID NO: 331373 - DNA, 516 bp, Homo sapiens
aattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgca

SEQ ID NO: 331374 - DNA, 335 bp, Homo sapiens
ccatgtcagcttactttttctgtagtgtaaggaactccctgtctggatggccagagtaggcaccttccttacactacagaaaaagtaagctgacatggtcctgagagaggaggacctaaagcaggatcctgagtagaaaatgagattagggcccaggaagaggacacaaaaaaggactgggaccttgtagacccaggttatcacccaggatattactggttgtatatgtactgggtgctggcatcatgtcaggtgctggagaggccagaaaaatcctctaagatgtagcaagcagaaagaataaaccatgagatctttgcctaccctcattctag

SEQ ID NO: 331375 - DNA, 877 bp, Homo sapiens
gtattggctatgtaattataggggctggcaaatctaaaatatgttgggcaggccaataggctagaaattcaggtaagagtgatggggcagtcttgagtccaatatcaataggtcaggtcagcagactggaaactcaagaaggatttccatgttacagtctggagagggaattccttctttttggggaaacctcagtctttgctcttaagcccttccactgattggatgggacccacccacattatgaagggcaacctgttttatctgaagtcaattgactgtaaatgttgaccacatccacaaaataccttcacaccaatatctagatgagtgtttggccaaacaactgggcaggatggcctagccaaattgacctataatatgaagcatcgtaaagtccatctgaaaaataagtgcaagaaaaaaggctaatcttacagagaaccatatgcggaagaactgaagaagagccacaagccatgaaaacatggactgggaagatgccttgatgaatgatgcagtcttcctggagaaagaatcagaagctctcccagtggaggctcgtttggtaaccaaggtgcctactctggccatccagacagggagttccttacactacagaaaaagtaagctgacatggtcctgagagaggaggacctaaagcaggatcctgagtagaaaatgagattagggcccaggaagaggacacaaaaaaggactgggaccttgtagacccaggttatcacccaggatattactggttgtatatgtactgggtgctggcatcatgtcaggtgctggagaggccagaaaaatcctctaagatgtagcaagcagaaagaataaaccatgagatctttgcctaccctcattctag

SEQ ID NO: 331376 - DNA, 643 bp, Homo sapiens
acttcagaagaaaaccacatatccgtcaagcattcatttgccattctccctaaccccagtggcccacgcagccactcatctgctgcttgcctccagatttacctattctggacatttatataaatggaatcacgttatgtcactttttgtgactggcttcttttgtttaggttttctttcttttatttatttattttttgagacaaggtgttctgttgcccaggctggagtgcagtggcccagtctcggcttactgcagcctccgcttcctgggctcaagtgatcctcctgcctcagcctcctgagtagctgggattataggtatgcaccactatgctcagctaatttttgtattttttgtagagacaaggttttgcccatgttgcccagtctggtctcgaaactcctgagctcaggccgtctgcccagcttgccctcccaaagtgctgggattacaggtgtgagccaccgcacccggcccataatgttttccaggttcatcctttttgtagcacataccagtactccattcctttttattgctgaataatatttcactgtttgatacactacacattgtttttgggtttttttgttttgttcgttttttttgtttgtttgtttgtttttcgagacagagtct

SEQ ID NO: 331377 - DNA, 389 bp, Homo sapiens
acatccacaaactcacctcactggggatcgggctcagacaccaagaggccttaccggaagcaagcagcagagcctttgcttacaagaaaacccaatttccatttcccggctgttctccccaattttgagcccctgaatgttcagagagccgcacaaaaagaaagttctctctggagcctgtaaggtcatgacagttagtgggaacgtggcctacctgccatctccttttcaaagaagggctggatgagctcgccaaacgtggtcctatctgccacagcctctttcagcagttgcccacagcagactgaaggagaggggaacagaaagacacccattaaattttaaataggaggaaggatgagaaaaaaagaacccccagtgctgcctgc

SEQ ID NO: 331378 - DNA, 313 bp, Homo sapiens
taaaatgtaacactgctactacaaaggaacatccctgctgaaggtttttgaaatcagaaggtaaaggaccaattaaaattttcatgcattcacaatctggtgactagtcgctcctaataagtggaaaacattcaagatagaagtattcagaaacataaatgcagagtgatgaatcttgtgacatctaagcagatcataagcagacaatttacactggatgttcagacatgatgattttcatattaggagaatatttgaggcaaggcacagtggatcatgcttgtaatcccagcactttaggaagccaagacaa

SEQ ID NO: 331379 - DNA, 359 bp, Homo sapiens
actgcatccaacgccgacacggattcggtatggcacattccttattcctttggcccagacagctctgttgcccaggctggagtgcagtgccctgatcatagcccacagcagccttgaattcctgcgaatcctttcagtgcagcctccgcagtagctgggactatgggaacacatcactatgcctagcttattttatttttgtttttattttttgtagagatgggggtctcactgtgttgctcaggcttgtcttgagctcctggcctcaagcagtcctcccaaagtgctgagattacagctgtgagccatggcacctggccgagagaacacttttccttgacatctctgaacaaagtgtg

SEQ ID NO: 331380 - DNA, 392 bp, Homo sapiens
tctcatcattcatttgggaagagaggaaaatagttaaggcattggctaatagattcctatatataatcatcagaccagaaagactgtaccctcagccgaaaccactaacttctgtttttctatgctgtcttaccatgtcctgtcagtctgtttggtttctctattctctctcagtatagaacatgccttcaatgtgtaaacaacacaagagtaaagaggaccttactgggagtggctggggtagagaaaccaagatttaactgtcagtcacttttactctgctccagcagagggtgctcaggaccaaacaagactctaggtcaccacatccttaccttaaaacccttcctcatcagctgcttctgggcaatctgggtctctgccattggcag

SEQ ID NO: 331381 - DNA, 229 bp, Homo sapiens
ttgtatttttagtagagacggggtttcaccgttttagccgggatggtctcgatctcctgacctcgtgatccgcccgcctcggcctcccaaagtgctgggattacaggcgtgagccaccgcgcccggccgacaatcctgatttctaattctcactctagcaattggtggttattcaactttaataaacctgcacaaccttgctcacagattaatttttccatttctacaa

SEQ ID NO: 331382 - DNA, 380 bp, Homo sapiens
cacaggtaagtaaactgggatttgaatgctagccatccagctccagggtccatgctcataatcgtaaggtgtaactgcttctcagcatggagagatgcctcagggctctgaggtcagctgtggttcaaaaacaggctcacaaagtaacaaaaggaaaaaatccatcaattgaattgcatcagaactaaatactttttttttttttttgagatggactctcactttgtcacctagactggagtgcagtagcgcgatcttggctcactgcaatctctgtctcctgggttctcctgcctcagcctcccgagcagccaggatcacaggcacttgccaccacgcctggctaactttggtatttttagtggagatggggtttcacc

SEQ ID NO: 331383 - DNA, 158 bp, Homo sapiens
ataatgagaccttgtctctaaaaaaaaaattaattaattaaaaaataaataagtaataggaatcagaccccagcatcatagttgtgcatattacctgttatttctttaagagatatcccttctccttgagttccatttttatgggaattacttgcttt

SEQ ID NO: 331384 - DNA, 555 bp, Homo sapiens
gcctgtcctagaatgttacttaaatgaactaacctgtgggatgtggcctaaaaggtaaagccaggcagttcttaatacaaacaggctgggctccagaagtctccttgtttagagttaaggagtaaactcagtgcccatgatgcccaggaaaccataagataaaacagcccttgggccaggagtgctgggattacaggtatgagccaccacgcccggcccagactgggtggtttacaaaatagaaatttatttctcacagttctggggcctagaaagtcccagacgaaggtgctggccaggtagttcattatgaggccttttctcttggcttgtaggcggccgccatcttactgtgagctcacatgacctcttagggaaagcgagctccctgaggtctctgcccatcaggacattaatcctatcagatcagggccacatccttatgacctcatttaaccttaactgcctcctaaaagcgtcacctccaaatagtcacgttgggagttagggcttcgacatgtgaatttggaggtgacacaaacattcggctcacag

SEQ ID NO: 331385 - DNA, 1916 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331386 - DNA, 1720 bp, Homo sapiens
  misc_feature (6)..(6): n is a, c, g, or t
agcggnacggtccggaattcccgggatgcgctggctctgctggcgctgagaaatggaccaattttgacaagatatagtgctgcagcgtgcctgatgggatatattcagtcatggcgtccgaactttccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331387 - DNA, 1875 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331388 - DNA, 1821 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331389 - DNA, 1756 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaaggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331390 - DNA, 1187 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtgggtcaaccctattcacagtaggaggtgactacatggagagtgaccactaggagcgaggaccattgggggcccacttggagactggctgtcacagcttcatggcatctatactatttgctagcctcatggaaaagaatgatctttattttttctgggtttttcttgttattacaggagtaaatgtcctcaatcttctacattgtagccagaaagagaggttcatcccatgttagaattttagagaatggtaattggcacatatacttactgaggagaacttaatggtaaaagtaatcctctacaggatgttttttccaattgtttaattatgtaagaaaa

SEQ ID NO: 331391 - DNA, 785 bp, Homo sapiens
gtaacggaagcaccagcaagtcaacgttacgggtccaacaatacacacctcagggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331392 - DNA, 995 bp, Homo sapiens
cctcgcctggctccctgccccgccccgcccgccgtcccccgcttggcttccagcgccgcttgcgctccggagcgctggctctgctggcgctgaggtgagtagagctgtccgcctcgtcgggtgattcaagtggcgaggctctctgacccggccccccggcggggacgccccagacgtggtcctgccaaagcgtccgggtcgcggcgagtgggacagcggagccgtccgggcctcgggtggccacagctgccgggtcctcctcccactctgcggcccgcggcccctgggacccgagaaccctgataccggaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactgaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctccaattaggaaaaaaaaaaaaaaggggcgcctaaaaaaccccaggccacgttagctaccctttgaaaagggccaaggaggaaaaaaaagagggggtacacggcggacagtggttgagacctctggggaggaacccaaagccaaaaggagaaactgcggtgaaaaa

SEQ ID NO: 331393 - DNA, 388 bp, Homo sapiens
cctagcttcaaagccacacactgttgtttctgttatatcctgttgattacacaggtcaaccctattcacagtaggaggtgactacatggagagtgaccactaggagcgaggaccattgggggcccacttggagactggctgtcacagcttcatggcatctatactatttgctagcctcatggaaaagaatgatctttattttttctgggtttttcttgttattacaggagtaaatgtcctcaatcttctacattgtagccagaaagagaggttcatcccatgttagaattttagagaatggtaattggcacatatacttactgaggagaacttaatggtaaaagtaatcctctacaggatgttttttccaattgtttaattatgtaag

SEQ ID NO: 331394 - DNA, 2003 bp, Homo sapiens
atctcagtggctggctaactcgggcgaaacggcgtgtgttttgcctaagactctgccagtgtttgttaccacagctgagaaaatagccttttacaaatgcttttaatatgtagcttatagttctctaatctccagcgttaggaaattggaatgcgtattctactaaattgagtacggggagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331395 - DNA, 1934 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactgtgagtctgtttattcaaatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331396 - DNA, 1604 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331397 - DNA, 1682 bp, Homo sapiens
cctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcaggaattggctatgagagggctgtatcatacctaccacagcttgctgaaaggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtag

SEQ ID NO: 331398 - DNA, 304 bp, Homo sapiens
caagtgctttgttggctggtggatgctcaggaaattataatacagaagccaaggtaacagctgaagtgtaccatgtgcctggcaaggtatcaaatgccttatgttaattattttatcttcagagtcctttaaaataagtacatttatttgtacaatgctctgaaaattgttttaatttacccgtgttgcattgttttctttatccttttgtatacatattttttgtacttcttagcatatttatatttcttactctagttttcaaatgttatttactggattttttttttttttgagacggagt

SEQ ID NO: 331399 - DNA, 168 bp, Homo sapiens
gctgcaaacttggggcattttcacactgaatatatgtttctaaaagctttacctggtggtgaagtgtgatactgcaagcctccctctttttggcattttaatcctaaacaaaaagtaaaatcaagtttctggaattcaggctcccataagctagtgccacctatgccc

SEQ ID NO: 331400 - DNA, 1888 bp, Homo sapiens
ccgggccgcgcctgggcgaacggccggagcgggctgggctgggcccgggatggcggtggccctggcgccggtcccggtggcgccccgcgcgagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331401 - DNA, 252 bp, Homo sapiens
caagtcctcggcgagctgcccaacgggcagcagctggcgcaagtagcctagctggagaggctcaccccaggaaggagggaggccaccgacctactgggccgacggactcccacacagggctggcggcgccgcggagctgggaggactgaaccaccggcctcgggctgcaggggaaacatttcaggctgactggcgctcgtggctgagactcccatagaaagcccggctcagaggggcattagggtcctaaat

SEQ ID NO: 331402 - DNA, 1891 bp, Homo sapiens
tgggcggtgtgcctgtgcgccggatccgggtggcgcgccgcgcgagttccttgagctggtgccaggtccagggtaacacgctccgtggcgaggcccaccaggcggtgctggggcacggccgcagagccgccaactgttgagcattgaggccctggctgctcggtcggctgatacatggcgcacactgagaggcctcaacgtcaccatctagcgaaccagtccatacttcactggccgtcgttttacaagtcgtggtgtgactgtcccaatagtgagttgctgttcgcagtcctactaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331403 - DNA, 1639 bp, Homo sapiens
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331404 - DNA, 2338 bp, Homo sapiens
  misc_feature (1924)..(1924): n is a, c, g, or t
  misc_feature (1926)..(1926): n is a, c, g, or t
  misc_feature (1936)..(1936): n is a, c, g, or t
  misc_feature (1939)..(1939): n is a, c, g, or t
  misc_feature (1941)..(1941): n is a, c, g, or t
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgaaaaaaaaaaananaaaaaacaanaanancacaaaaacaacaaaaaaaaaaaaaaaaaaaaaaaaaaaaaaaacacaaacaaaaaaaaaaaataccacaagagaggagggggggcggctcgaaataatcactctctccgaccaggggagcgcggccctcaattttggaccccacaccacggtgtgttattacagagggggagcgcacccaatgtagtggacgcttatatcatgtaaaatatacaggagagaggaggagaggcgccgtcattacaataacacacaagagcgtacaggcgggtggcgagacataacacgtcgccacgcgtgagaggcaaccatcactagattgagcggagagaccctcctcctcttgctggcggccggggcagagagaagcacatgggggccggacaccaaatcagcg

SEQ ID NO: 331405 - DNA, 2517 bp, Homo sapiens
  misc_feature (2517)..(2517): n is a, c, g, or t
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgaaaaaaacaccacaaaaacacaacaacacacaaaaccttttctgggcccggcctcgcgcgccccccggaaaaacaacgtttcttctcaacaaacccactatcgcggtcgccgtggcaggacgccagcgggggcgccccccccaaagtaagcggtctaacacgcatgagaaccaccagggcggccccaccatgacggcagctggttgccccccaaaaggggagagaaaacccggggggcccaaatcgccacacaacagcgagcggcaggggaggacactctcacacgcagaccaacactttatcaaacaaacacaaagatcagcggctgcggtcgcggggggtccaacccaacaccgccgcgagagcgtggtctcctgtgggaagaaaaaacaaacttccaccgaacgaagaacggggacgcaactctcccagcaggaaaaagagcacacaaatcaacaagccgggcggcagacctccaaaccacgaacagaccgaggaggggagtcgccccaccaacacgccgaacaagacctcgcgacagacattcccgcaaaaacattgatcgacgccccgccgaggagatcagtcagcggagtgggcgatcn

SEQ ID NO: 331406 - DNA, 1301 bp, Homo sapiens
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331407 - DNA, 1912 bp, Homo sapiens
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331408 - DNA, 1990 bp, Homo sapiens
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgccactggacctgaatgcctttgatgtgcaggcctcacctaatgagggttttgtgaaccagaatattaccatcttctaccgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331409 - DNA, 1211 bp, Homo sapiens
aacttatacggcgtgtacgaggctgggtggtgatgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctg

SEQ ID NO: 331410 - DNA, 2471 bp, Homo sapiens
caagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgaaagagaagaagacatagacacaaaaaacacagacaactaatcaagaaatatcagaaggaaaaggaatatcccatgaagcaacgtggaaacgagaatgaaaaaccctgcggagttggatccacagaataccttcagcgtcgagctgacatatctgaacacccatgtgctggctgaagaaggacacgatgttcgaaaagaataaaggcatgaaaagaacaagaaagaaaatacggagccctaaagaccaaggttaaacacaacataatggaaggaaaagcccaattcaaaatctaccataggaaacatatgtaaacaggaacaaaacagaccaatatcgagaacatgttggagaaagaacacaagacagagaagaaacaaaagccagaaaaaagcacagtaaataaacaggcacacgacagaaagtaaaagaaacatacacaagagaacaatgcaagcgaacagaaacccaagacaaaaactacagaattacaacggcaccaactgaagaaagaaagacatgagaaaaagtaaacacagttacacaataacaaagaacta

SEQ ID NO: 331411 - DNA, 387 bp, Homo sapiens
gctgtctcaaaccttgatcttttccagttgcaagccactgggcactcaccatttgtctctcttggaattacccacaccatgctgccaacttgtatctgactcctccttcaaagccatgctcgacatgtacagttgtgttaagtaggtcgtcagcctgcccaaatacatatcagcattcacctaccttccttttctatgacggctttgctgcttttctcttttcccatgtgtttacctccttctcctctgatatgttttagatttctgtccccatgcaagtcttatgttgaattgtaatccccagtgttggaggtaaggcctggtgggaggtgattaggtcatgggggcagatttcccccttgctgttcttgtgatagtgagttctca

SEQ ID NO: 331412 - DNA, 271 bp, Homo sapiens
ctgtaacagttggctgtcccattgcataatttatttttattgccaagtaggagtgggtgaactgttccagatcacatcaaaacaccactgtaatcttaaactatttttcattatgtataggtttttcagagagcttactcatttgagtttgaaaatatctgaccagaactcccaatgagctattctcctgaactctgaggcaaaccacttagatgaaactggcagtccttccaccacaggaaaaggaagacagctgataaggtacgaatag

SEQ ID NO: 331413 - DNA, 3482 bp, Homo sapiens
aagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaaaaaaaaaaaaaaaaaaaaaaaaaaaattgggggggggctcagggccccagaagaagagtttaaagaacaacagaggtggggccgacggggagccagagagcgagaaaggaaacagtgggaaaagcgggtacaaaagaaaacccggggccaggaaccaaggggagaggacactccaccaaataaacaaaaggcccggggggacaaccgagagttctagaaaaaaattcaaaagggaaccacaggagcaacaggggactacaaaagggagccaaggaggccgaaata

SEQ ID NO: 331414 - DNA, 3089 bp, Homo sapiens
cctggctctgatcttaggcggctctgaacttaggcctggctctgaacttaggcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaaaaaaaaaaaaaaaaaaaaaaaaaaaattgggggggggctcagggccccagaagaagagtttaaagaacaacagaggtggggccgacggggagccagagagcgagaaaggaaacagtgggaaaagcgggtacaaaagaaaacccggggccaggaaccaaggggagaggacactccaccaaataaacaaaaggcccggggggacaaccgagagttctagaaaaaaattcaaaagggaaccacaggagcaacaggggactacaaaagggagccaaggaggccgaaata

SEQ ID NO: 331415 - DNA, 2283 bp, Homo sapiens
ctattgaagacacagacaggatttttaaatgtacaaagctgtacccctggtatggcaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaaaaaaaaaaaaaaaaaaaaaaaaaaaattgggggggggctcagggccccagaagaagagtttaaagaacaacagaggtggggccgacggggagccagagagcgagaaaggaaacagtgggaaaagcgggtacaaaagaaaacccggggccaggaaccaaggggagaggacactccaccaaataaacaaaaggcccggggggacaaccgagagttctagaaaaaaattcaaaagggaaccacaggagcaacaggggactacaaaagggagccaaggaggccgaaata

SEQ ID NO: 331416 - DNA, 3379 bp, Homo sapiens
aagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaaccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaaaaaaaaaaaaaaaaaaaaaaaaaaaattgggggggggctcagggccccagaagaagagtttaaagaacaacagaggtggggccgacggggagccagagagcgagaaaggaaacagtgggaaaagcgggtacaaaagaaaacccggggccaggaaccaaggggagaggacactccaccaaataaacaaaaggcccggggggacaaccgagagttctagaaaaaaattcaaaagggaaccacaggagcaacaggggactacaaaagggagccaaggaggccgaaata

SEQ ID NO: 331417 - DNA, 3137 bp, Homo sapiens
aagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaccgccctctccgtacccctgccccgctcccccctctttctccctgcttcccccttccccccccccccccctgcttgtgcattgagtattaaaaaattagatgtata

SEQ ID NO: 331418 - DNA, 2984 bp, Homo sapiens
aagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatatgccattcttgctgaagaatggcatagaagagaagcagagtaaacaaacacactgtgtgtatcattcacactgagaaaagtacagtgaaatgatcatagctctttggctgaaagtacaagatacagttgcttcatacatttaacataagata

SEQ ID NO: 331419 - DNA, 866 bp, Homo sapiens
gcgtagactattggtggatcaggaaaagaaagatgtggcccaaagcctagagaactatacgtccaagtgtcctgggaccatggagcccatcgccctccctggcggcctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaaaaaaaaaaaaaaaaaaaaaaaaaaaattgggggggggctcagggccccagaagaagagtttaaagaacaacagaggtggggccgacggggagccagagagcgagaaaggaaacagtgggaaaagcgggtacaaaagaaaacccggggccaggaaccaaggggagaggacactccaccaaataaacaaaaggcccggggggacaaccgagagttctagaaaaaaattcaaaagggaaccacaggagcaacaggggactacaaaagggagccaaggaggccgaaata

SEQ ID NO: 331420 - DNA, 435 bp, Homo sapiens
ttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcatgagtaccttataataataataatgtattctttgttaacaatgccatgttggtactagttattaatcatatctaaccaact

SEQ ID NO: 331421 - DNA, 185 bp, Homo sapiens
aaatagtatgctgttgccacgtctgaggctggagcttgaagtctacatggcaggtagtcagaaaaggaaaattaagagcagtctggaatcccatgagggcagaatgaaacctgtttccattcttgttgcctctgaccttggtgttaaacgaggatctttgttatccttttttttttttttttttt

SEQ ID NO: 331422 - DNA, 431 bp, Homo sapiens
cataaacataagtcagatagaacctgatgcttcttaaacatgccatgcctttccaagtctctgtttatttccccacccactgtgctcacacagcacagagcccatatttacaattaacacacatagaggtgcataatctttggcttacatgcctatcccttctctaagctgtgaattcgtactcctctttttatccccaacgcctaatgtgggccagtcacaaaaattggatactcagtaaaggtttgtggaatggctgaatggaataacatattgcaggaatctaaaacgtggctgataaattcatcttgcccttcctcatgatgtccaggtcatgagcttgaatcacctacacaccattcattttgcttactgtcatggtgagatcaacattaagaaccctatctttttatctaaaacatatgtaagct

SEQ ID NO: 331423 - DNA, 191 bp, Homo sapiens
agctccttgttggctgattcagcagttcctcaatggaccttggttctgcccatgtgcagctttcatcctcaggttggatgtgtgatggacataggagttacaggggttacattcaaaatgacaacatccagaggaagaagagaagttgtctctttcttgtgtcccttttttagaatggaagaaacttttct

SEQ ID NO: 331424 - DNA, 568 bp, Homo sapiens
tgggaagagtgcgaccgggaactctatcctggggagcctcgtcttcacctctcggctccgggcccagccagtcaccaagaccagccagagtggcaggaggacatgggacggacaggaggtggtggttgtggacactccttccttcaaccagatgctggatgtcgaaaaggacccatcccggttagaagaggaggtcaagcgctgtttgtcctgctgtgaaaaaggggacacattttttgtcctggtgttccagctgggacgattcactgaagaggacaaaacagctgtggcgaaactggaggccatctttggagcagactttacgaaatacgcgattatgctgttcacccggaaggaagacctaggggcggggaatttggaagacttcatgaagaactcagataacaaagcccttcggcgcatttttaaaaagtgtgggcggcgagtttgtgcttttaacaacaaagaaacaggccaggcccaggaaacccaggtgaaagctcttttaacaaaggtcaatgatctgagaaaagaaagtgggtggtccgggtatccccatacacaggag

SEQ ID NO: 331425 - DNA, 295 bp, Homo sapiens
aggtttaattggctcacagttctgcgggctgtacaggaagctgagcagcttccacttctgcgaatgcctcaggaaacttaaattcacagtggaaggtgaaggagaagtagccatgtcttacatggcccagcccaagcaagagagaaagggggaaggtgctacacacttttaaaacaaccaggtcttgtgataactcactcactatcacgagaacagcaccaaggggaatggtgttaaaccgtttatgagaaaccgtccccatgatccagttgccttccactaggccccaccttca

SEQ ID NO: 331426 - DNA, 290 bp, Homo sapiens
  misc_feature (25)..(25): n is a, c, g, or t
ggcacgagtctgcactcagtttatnccctactcaaatcatataattaaattaaacggtatccctgaaaataaaaagaacattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331427 - DNA, 297 bp, Homo sapiens
  misc_feature (33)..(33): n is a, c, g, or t
  misc_feature (144)..(144): n is a, c, g, or t
agttcacaagtttattatgaaaaacactgcagngctcttgggcagtcacatcgtcttacaggaaggggaaaaaacagttctgttcaaaacaactcaccaggttctgacaataacaaagaacaacatggagctgagatttgatgnagggaataaactgagcccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331428 - DNA, 2070 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331429 - DNA, 2433 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagctt

SEQ ID NO: 331430 - DNA, 332 bp, Homo sapiens
cggacgcgtgggtcttttcagggataccgtttaatttaattatatgatttgtctgcaaataaaaagaacaatttcaaaactcacaagtagaagggaggcgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331431 - DNA, 540 bp, Homo sapiens
taaccgggaggcggagttggcctaattagattaatactagcacaactctgcggatatcaataaaatctgactttgctaaaggtaaagaaatttgtgaacaatactaaacaataacttcccttttaaaccactcttttcagatcttctgtctacatggtggtctctcgccatctatagatacactggatcatatcagagcacttgatcgcctacaagaagttccccatgaggtatgacttttatttgataaaattctttcagaaaacttattagggagtggagaagtttaattgtaagttcattagatgtattctctcatataattctcaaaaacaacttgaggtgtgagcactcttgtctgccctgttgttcaaaagaagctgacattaagaaacctgccaagatcacaacagctgtgaagctgggcttattaggacctgggttgtctgtcttagactctgaaatttgcataatataggcagattaattagggcatgttgctgctgggtcccatggatgtcagctgtgtctcataaagtc

SEQ ID NO: 331432 - DNA, 3170 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcataaaaaaaaagagtagaaacgcacacacaccacactagacaaaagttacacacaaacaacacgatagatcgcgccagcgccaacgaagaaagaaagcaagaaaacaaccaagcaggagaagccgcaccacaaaaattattgtggaccgcgccccccgcagcaaagacaaaacacacacggcgagggggggaccgcaaaataataagagcgcgtgcagccaaagtaaacacaccacgagggggcgtcgaccaaagaaacaccgcagggacgagaggaaaaaaagccggcgagtagtctctacacggggcgcta

SEQ ID NO: 331433 - DNA, 3062 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttt

SEQ ID NO: 331434 - DNA, 2047 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331435 - DNA, 1561 bp, Homo sapiens
gagatccccgaggcgtgggctgggtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331436 - DNA, 2003 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331437 - DNA, 2037 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagggaataaactgagtgcagacaaatcatataattaaattaaacggtatccctgaaa

SEQ ID NO: 331438 - DNA, 2016 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcacttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331439 - DNA, 1033 bp, Homo sapiens
  misc_feature (33)..(33): n is a, c, g, or t
  misc_feature (144)..(144): n is a, c, g, or t
agttcacaagtttattatgaaaaacactgcagngctcttgggcagtcacatcgtcttacaggaaggggaaaaaacagttctgttcaaaacaactcaccaggttctgacaataacaaagaacaacatggagctgagatttgatgnagggaataaactgagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331440 - DNA, 1110 bp, Homo sapiens
taaagtactaaaaaaaaaacaagttttgtaattagggggaaaataaatacatgtgtaccttacaggttgtataaagtacaggagattattaagtcatccagaaaaaaagcattaacatttcttaagcccctttggcaggggtgggaatgagtagagatttttttctctcttgagtgaagtaacatttagttgaattgagggagtaaagtaagatttttgtctccttttccttgcagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331441 - DNA, 688 bp, Homo sapiens
cgtgtctagaggatcccggagagcatccttacacatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331442 - DNA, 1491 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaaattcaaattgggggaaaacttttggaacgatactctaaaatactctttcttgcagtttgtgaaccccccaagggccaaccccttccgttaagaaggggcggagccacatgttactcgtcgtaccccaagaacttaaacttttcccctgggttacactggaacattcttaaaaacctttgtgttaaaccaaggtaaatttggccccacttg

SEQ ID NO: 331443 - DNA, 404 bp, Homo sapiens
tcttaagcccctttggcaggggtgggaatgagtagagatttttttctctcttgagtgaagtaacatttagttgaattgagggagtaaagtaagatttttgtctccttttccttgcagggatataactggtgccatgaccggaatgtagtaacgattttcagtgctccaaactattgttatcgttgtggtaaccaagctgcaatcatggaacttgacgatactctaaaatactctttgtaagtaattctacctgaacattttcttgcattactgaatatgtagggttttggtttatttattttgagagagagggtgtcactatattgcccagtcttgtctcgaactcctaggctgaagtgatcctttcaccttggcctcctagagtgttggggttacaagtataa

SEQ ID NO: 331444 - DNA, 3116 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttt

SEQ ID NO: 331445 - DNA, 2609 bp, Homo sapiens
  misc_feature (2608)..(2608): n is a, c, g, or t
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgaaaaaaaaaacaaaaaaaaaaaaaaaaaaaaaaaaaaaaacaaaacaaaaaaaaaaaaacacaaaacaaacaatacaaaaacaaaaaaaaaacaaaccaaaggacggggacggagagcaataaaacaaaagcgagaggaaaaaaaagataagaaacgatataaagagaggacagccacgaccaaaggcacagaaaaaaagagagaacagagagcaaaaaacaagagagagagagacaaaaagaggaagcgaaagagagagaaaaccaggggggaaacaaggagacaccacacaatatacgacgaggagaaaaaaaacggcggggagagtaacaaacaagctggggagaaaacacggagaataaaattataacggggagcgaagacagagaacaggagcagggaggagaggaggagggcgaggacgggaggggggtgaggcggacagtggagcgagagtgaatgaagagggggagagagagaggaaaagagaggcagaagcgaccaacgacgagaggggtgctgctgccatgcctcggtnc

SEQ ID NO: 331446 - DNA, 2106 bp, Homo sapiens
  misc_feature (518)..(518): n is a, c, g, or t
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgcattcggagccaggccnttgggaaaaacccgggaaaggccttgggccaaaagggcaggcttgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331447 - DNA, 2063 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaacacctgtggggtaagcccacaagcagtaatgttttttttttaatattcttgtaaaat

SEQ ID NO: 331448 - DNA, 3062 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttt

SEQ ID NO: 331449 - DNA, 1345 bp, Homo sapiens
tcttcttcctcgcagccgcagagctgacccagctgctccacgatccattcctccagcaccagccgcttccgaagctccttacgatcgtatttcactgtcacttttccctactctgtatgggggatctccgagatcccccatacagagtatattgttgaagaggatagctattagaaggattatggatgcggttgcttgcgtgaggaaatacttgatggcatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331450 - DNA, 1103 bp, Homo sapiens
ggctgtacgtctcgaaagacgggagatagcggaccacggcgtcgcgacgtgtaagcctaccctggcgggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactga

SEQ ID NO: 331451 - DNA, 1690 bp, Homo sapiens
tccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggaggtatgctgtgttctctgaaatatgacttgtttttttagtaaacttaaggaaagaagatattagggagttttaaattaatgacatttgtgagaaattccatctattccttctgatgagtttatcattatagcctgagccttttcagtagatgcacactactagaattaaaagctcaagcttttgattacaatgaatccattaacatgttttcagagaaatctgaatgactaggaagtacttgagatttaagagtgggaaagtaagatatagggagttggtgtgcatgtatgatattttatgatcccaatgttatttcgtatatttaatgtatgtatgtaggagagactggaaagaaatacacgaaaatgttttaagtggtcctttggatgctaggattacaggtgatttgaaagaagggaaagaggcaaaggttcttgacatggcacactgattagaatatttttaaaataaggtcctaattagattaatactag

SEQ ID NO: 331452 - DNA, 369 bp, Homo sapiens
gaaattaggaaggagggaaggaaaaaaggaaggaagaaggaaggaagggaagtaggaaaggaagaaggaaagcaaaaaggaagaaggaagggagggaggcaaggagggagagagggaaggaagaaggaaggaaagagggagggaagaaggaagaaaggaaagaaggaaggaaggagggaaagaaggaaggaagggggaaggagggaaggtaggaagggaaagaagaaaggaaggagggaaggaagaaaggaaggtaggaaagaaggaaggaggaagtaaggaaggaaagaaggaagaggaaaggaaggaagaaaggaaggaaagaggaaggaaggaagaaggagggaaggaaggagggaaggaagaaag

SEQ ID NO: 331453 - DNA, 430 bp, Homo sapiens
taaatagaaattgcgatcaaatcaaggaaaatcacataaagcaaattcagaaaaatctgcttcctcagtgtagctctcttgtattttacaatgtagctctcttgtattttattttcatggaaaatcaccgggggctgggaggggtggcaggaggaagctctccctcttcccagttgttcttctttccatctaatcccacactttcccttctgacacctgcttcccgattccactcccttactgccaccttctcacatccttaccaacatctactgacacctcccccatcaacccagcctcctccactgctcaggtgaacaaagctgtcatggccagaatggagcatgaaggcccggtcaccgagtcatatcaaaggccagaaaacaagggagacggaggggagcgggctcaagggccagaggaaagctcc

SEQ ID NO: 331454 - DNA, 3286 bp, Homo sapiens
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttggtacagtttaattatggaacattaaataattatttttg

SEQ ID NO: 331455 - DNA, 1023 bp, Homo sapiens
  misc_feature (1011)..(1011): n is a, c, g, or t
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaaccaagggaccttggcttcttnaccaccttgcaa

SEQ ID NO: 331456 - DNA, 1741 bp, Homo sapiens
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgggtgcagaataaggctcctctagagtcagctc

SEQ ID NO: 331457 - DNA, 3358 bp, Homo sapiens
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttggtacagtttaattatggaacattaaataattatttttgaaatgattgctatgcaggtttaaacttttttaatgatcaaaactattaaaaaccagagttctttgtttaatc

SEQ ID NO: 331458 - DNA, 807 bp, Homo sapiens
cagtgggtggacagttgcagaaattatgccatgtggaatattatacaggagttacaaagggtaaggccattctaaatacagtgcctcagaagaaggttcatgataagatgttatgttaaaaaagcaagcaaaaacaacagtattagatgattttgctttgctttgttttaatttggagctactttttttttaatttccatttttattttggattcatgcagtacatgtgcaggtttgtcacaagggtatattgtgtggtgctgaggtttgagattctaatgatcctatcaccccaatagtgaatatagtaaccaataaaaagttttacagtccttccccctcttcatccctccatttttagtccttgcctccctccctccttcaatgtctactgttcccagctgtatgtctgtgtgccccccagatttagcttcaacttataaatgaaaatatgcactatttgttttctttttctgtgttagttcacttaggataatggactccagttgcatccatgttgctacaagggacataattttattttttatggctgcatagtattccacggtgtcggtgtatgtaccacattttatttacccaatccaccgttgatgggcacctaggttgattccatgtcttagctactgtgaatagtgctatgatgaacacatggcaatacagtgcatgtatctttttggtagaacgatttcttttcctttaggtatatacccaataatgggattgctgggtcaaatggcaattgtatttttagttctttcagaactctccaaactgctttccacaggg

SEQ ID NO: 331459 - DNA, 2344 bp, Homo sapiens
attttagtggtggagtcaatttatttctgagacgatctcatttacctgaatgaggagctcatatttattttcaggatttatgaggaatccaagatgaatttggagcaggagaggccgtctgtctgcagtgccccaggctgctcccagcgcttcccaacagaggaccatctgatgattcataggcacaaacatgaaatgactttgaagtttccttcaataaagacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccgagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaa

SEQ ID NO: 331460 - DNA, 2025 bp, Homo sapiens
agagagcaagtgagcgagagcccagccggagggagagccagagctaggcgcaaaagaagggccagcacattacatcatcgcttggcctggaatcaaatgggaaggatatgactcactcaagctagttaagctttggctcaaattctacacacactcattccagagctctcatgttctgcacctcaggagggaattcagcctcagtgatgtccatgaggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccgagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaa

SEQ ID NO: 331461 - DNA, 2318 bp, Homo sapiens
  misc_feature (15)..(15): n is a, c, g, or t
gatctgatgaatccnaggagtggagcaagaggcagattttggacacggttatgagaatgacagaaactgcctaaagcatttatgctctggcattcgtccctgtttctggaggtccagtaagcgcttcccaacagaggaccatctgatgattcataggcacaaacatgaaatgactttgaagtttccttcaataaagacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccgagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaa

SEQ ID NO: 331462 - DNA, 494 bp, Homo sapiens
agagagcaagtgagcgagagcccagccggagggagagccagagctaggcgcaaaagaagggccagcacattacatcatcgcttggcctggaatcaaatgggaaggatatgactcactcaagctagttaagctttggctcaaattctacacacactcattccagagctctcatgttctgcacctcaggagggaattcagcctcagtgatgtccatgaggtttgtttttaattttattttcttttctcctgattttatagattttttttgcccctactgccttctgtttttgagccttcgtcctcctcctcctcctcttcattttctcccccttctccctttctgcccgtctttgtttctcctcttcttccttctcctctttccccagcccctccgctcctcttcttgcccgaagaggcatttcttttcacttcgatcagagtttttgttctagcacagagacctgaatgagttgaacagaggccgggttggagga

SEQ ID NO: 331463 - DNA, 2159 bp, Homo sapiens
acacttcagagggctgagatttctgagtaaacaaaggatttcaccaccaagttcctttcctaagatgcgagcgtttaggagacttattggcttgtttctattgaacatcagttagataacagaggtcaggaaatgaagtggaatttgatatattaactaggaagcagcaaaggaaaccaggcttgtgttttatttgttattatttccctaatatcctcaattatgtgactctcccatcagtggatctgatctgctgcacatgtgacattgttgtccctgctgttctggacactggggagacagggccagggcaccaggaatcatgtttgtttgtttttttctttgtcccaagcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccgagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaa

SEQ ID NO: 331464 - DNA, 2662 bp, Homo sapiens
  misc_feature (145)..(145): n is a, c, g, or t
aacatttacaacaaagttgattctgtgtagggttggaggctagacagttccacaaatttttagtcacattttccatgtcagttaaatctagggagttcaagactactggaaaaattagtctcattactaaaagaaacttagagancgagggaggtaccagagtctaggaggtacctctgggttgcagaagtaattgtaaaataccagacctgttctttttactaaaagctagtttcactatcttctggtctgaaatactgaggcaaatactcaagacttattttcttcctaatcttgctggtgaaacagaagttactagaaagaaaggaagaaaaaacttgatttggtgactgcaggaagcaacacgttgctgcttttattctacagataatgatttatgaggaatccaagatgaatttggagcaggagaggccgtctgtctgcagtgccccaggctgctcccagcgcttcccaacagaggaccatctgatgattcataggcacaaacatgaaatgactttgaagtttccttcaataaagacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccgagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaa

SEQ ID NO: 331465 - DNA, 1868 bp, Homo sapiens
gacagaagtacagctttaaatagccttgcagatacatttttctaaaaatgcagacctgaggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccgagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaa

SEQ ID NO: 331466 - DNA, 5895 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331467 - DNA, 6267 bp, Homo sapiens
aaaaaataaaacctagactgggcatggtggctcacgcctgtagtcccagcaatttgggaggctgaggcaggtggatcgagaccagcctgggcaacatggcgaaaccctgtctctaccaaaaatacaaagaattagtcaggtgtggtggtgcgcacctgtagttccacctacttgggtggccaagatgggagggtcacttgaatctggcaggaagaggttgcagtgagttaagatcatgccactgcactccagcctgggcaacagagcaaaaccctgtctgaaaaagaaaaagaaaaagaaacaaaaaatctaaaaccgatctcctcttagtatgtgttagattgtgaaatgatgcttcggtatgatgtccttttaaagcattttagggaagggaagttttcagaaagcctttgttttccagtgacatagtggtgacttggtgggttctcttaagttatttgcatttggaagtaaatttaccaccacgcctactcacaggccgatctgggtaaagaatgtcttgttccaagttaatgcttacaaactatgcttaattaatctttcagccgtagctgaaagcaaagttaaggattttgaaggcaaaggctctggtttctccttccccatgtctgaaaaccgcccttagcctgcacaaggtgaacagtggaaatcattggtgaggaatggccacccactgccctctttactgtgtaggagcagatctgatgatgaacagagcagcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331468 - DNA, 5743 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331469 - DNA, 5772 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331470 - DNA, 5967 bp, Homo sapiens
acagggcaagaatggctcatggttctggatttcactggggagaagcccacacagccttcctgctgggaccgcccaggccatacccaaagaaatgactccaaagacagtaagtgggccaggaagacaaaaggctgttctcttgccatgaatatgtgtatccaaccatcgttcagaagtaagaagtattatattatttgtatcaggcctttctcttgaggccacccagattttaaatattttcccatctgcatgagaaaaatgcttgaaagtgtcatgtaaactgacaatttaaatagaatagatagaaagatagaggatgggggtgggcagatgattccttgggtagaatggaactttctccaagttctggaggctctaatggacaagatgccaacctcgggagttttcctagccggacctcttgaatctgtcccaggccagcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331471 - DNA, 6605 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaaaaaaaaaaaaaaaaaaaaaaaaaaaaaaaaaaaaaaaaaaaaaaaaaaaaaaaaaaaaaaaaaggaaggaaggagagaaacaaaaaacaaaacctgcagcacaaggagagaagacacataataatgaggcgaggagcacaagaatgacaatgtatgtctgcaaggcagcgggagagaactagagagagagagcgaagcggagccgcgaatatatgaatgacggagcatggagagacgacgcgacgaatcaatgacagtggtccgcaatgcaggacgaggatacaaacgagcatcagatgagagaagggtgctacatcataggaggaggcgagacgaatgagctagcatgtcagagatggaggtgaaagagagaaaaaagaagaaggtgagagtgaggagataaagacgacacgccaaattacaggaaagtcaagtaaatgagaataagcaaaggaacaaagaaggatagaagataagaacaaagtaaaaagacagagaagtgagaaaagccaagaaagagaggatgaagacgacaaaccaaagaacgggagtagagttatcgcacttgctgtggacgagggaagatgtaggagtgcacgataggcgagggagaacggagacggaggagcagatggtaatacgagaagatacaggattcatagcacgaggggagaggtggatagacacaggtagagtagataacgtgagagagatcagatgaaagaagtgggcagcacggcgaggtcggaggaaggcgtaggcaggggggtggtaggggggt

SEQ ID NO: 331472 - DNA, 5244 bp, Homo sapiens
  misc_feature (304)..(304): n is a, c, g, or t
ccaggctagactaacatcacaattaaaagaactagagaagcaagagcaaacatattcaaaagctagcagaaggcaagaaataactaagatcacagcagaactgaaggaaatagagacacaaaaagcccttcaacaaatcagtgaatccaggagctggttttttgaaaagatcaacaaaattgataggttaggtctacctggagtaaatctagttgttctgacttctacaccccttacgtgacaaaattctgctttctcctttgctttgtttttcttaacatccctcttctttcctatcttcctngttaggtctacctggcaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331473 - DNA, 5880 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattgaaacttctaaaactaggcatagttttagaaggtacaatagcaattaggtgacaagcaaaacagaaacaggtcacagctg

SEQ ID NO: 331474 - DNA, 5852 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagctttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331475 - DNA, 1217 bp, Homo sapiens
  misc_feature (172)..(172): n is a, c, g, or t
cgccctgcccgtagttctggttgtaattcgagtggggtcttgaatagaaagccaggcgcccgcgatggcccattcgcgggcgaggggatgcgtcgtcgacgcagcggtcaccactcacccgcacctgcatgtccttaccattcctggagaacttccacagacggtgttcctngttaggtctacctggcacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331476 - DNA, 1163 bp, Homo sapiens
cacccaggcgcacttctggtggttgcctggcaatctttggtgctccttggcttggagatgtatcaccctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331477 - DNA, 516 bp, Homo sapiens
attctaatgatgctattgaaacttctaaaactaggcctagttttagaagtttcagtagcatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctaaaaacacacacatacaaaacaccaaaatcaaaactacaatacaaaaaaaaaaagggggggggcaaaaaaaatccc

SEQ ID NO: 331478 - DNA, 657 bp, Homo sapiens
gcattttagggaagggaagttttcagaaagcctttgttttccagtgacatagtggtgacttggtgggttctcttaagttatttgcatttggaagtaaatttaccaccacgcctactcacaggccgatctgggtaaagaatgtcttgttccaagttaatgcttacaaactatgcttaattaatctttcagccgtagctgaaagcaaagttaaggattttgaaggcaaaggctctggtttctccttccccatgtctgaaaaccgcccttagcctgcacaaggtgaacagtggaaatcattggtgaggaatggccacccactgccctctttactgtgtaggagcagatctgatgatgaacagagcaggtgaggtatggaccaaaagctcgggggcttctatagattagacattttttcttccctttcaacgcaaacaaatcaagaacgcatgtatgaattttactgtagaatggaggccttcttcaaattgatgttattaagaaaatctgcttggcttttctgaacttcacactgagtgtagtgactgtgtgtctttgttttctccttccgtcgcccgtgggcacgcagcacgtgtggagtgagagcgaggactgcctgcctttcttgcagctagcacaggattacatctcctcctgcgg

SEQ ID NO: 331479 - DNA, 5679 bp, Homo sapiens
ggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttggacgcttgagcaggcgtcattgcttggaaccctaataaacgatgcactctacaaatgaaagtgtccttgaccatggatatcaatatagcagaaatgccaggtcttagatgattggaatgtgggggccca

SEQ ID NO: 331480 - DNA, 317 bp, Homo sapiens
agaaagaactgaaactggaggcatctgttcaggcacccagagaaagcctcacgcgcacaaagcagcaaacagaacaaaccccagtgccatcatggagcccagacttgagcacacagggaccctggcgtggagcacgagggtgccaaggcccgcaggtggctgacttgtgtgctctggtgccatgctcagatttgatgggatgaccctgcaattgcctgctttgtgagccacacaggcctgggtcaaaaagacgacggaccaccagcctgggcaacacacaaagcgaaacctgtctccacttaaaagataattagggt

SEQ ID NO: 331481 - DNA, 697 bp, Homo sapiens
tggtctcaaactcctgacctcaggtgatccgcccaccttggcctcccaaagtgctgggattacaagcatgagccaccgcacctaacctctccaaatatttttagaaagagctgctaagagctaggtggaattgtaagggatgtgtccatgctcctcctgcaatcttcacctagaatataagaggatgaggatggcacactagattttttttttttatctagtgtgccaggaagttatcagagagcttcaaacaatggagttactggatctggtttatggtttccaaagatcactctgactactatgtgtagaatggattgcatgaggccaagagtggggtctcagttacaacagcatcatgatcgattgctgatgttatgacttagtattttggttaatataattatcatttatttccttatgaatacgagtaccaagtgaaataccagaatagcactcctattttagatcaacgaggataggggagtttttgcacttgggttcagaagtacttgatttgtaaaccccaagacattttctgtaaaaatttgaggttgtgcatatttttctggagtcaaagttcttcttagttgcttaaagggatatatgtcccccaaatggtgacttacatgctgaaaaactgggggcataccaggtcatttcctgaagcttgttcccagctctaaaatatgaacac

SEQ ID NO: 331482 - DNA, 253 bp, Homo sapiens
tggtccacagatgctcaacagaaactcccgcaccaaatcacttccagctttgacatctctgccaaagtttttattcagcctctcagttatatttctacccaactttccacactggtagacagaataaaaatcttcacctacaatttgtccatctttgacactaccaagcacgtgtatcttaagtgttgttagatgttgaagacaaacattattttgttagccaagaagttgctatgttggcaagaagtcatct

SEQ ID NO: 331483 - DNA, 316 bp, Homo sapiens
gaaaacacgtcttcaatcagaaaaagaagcaatccttgtgaaactcccaagtacactttttgaattgatggatccatttgttacactcttcaaaaagtttcaacgctgccctcagctcttgctatctcatttcggtcttttgacccttaagtcttagttattccttatgacatggtaaagattggacagtaaaactaattgtgacagtactcaacagagaaaagcctgtaatgaatagcatcagggagaccttgtgaagaattgcactttaaacataaaaggttgcagatgaattgaagaaaggaaaaaaatatga

SEQ ID NO: 331484 - DNA, 4023 bp, Homo sapiens
taatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggattttccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaagacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcagaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaatcagtaattttgtgtttggggtgtgggggtggtgaaagggaagtagaaccgaaacaagattagtcctgagttaacaatggctgcaagctggatacatggaattcagcacacttttctccctcttactgattatgcttttgaaattttctcttgtaaaacatttagaaaacaaaaacaaaaaaaatgtgatttgtttctgtcttcaaaatctcattagaattttttcactggaggaagattttcccttgcttctgcataaaattttaactccataacttataagctcactctttattgttactttctaattgacaaataaaaattgtatatta

SEQ ID NO: 331485 - DNA, 3678 bp, Homo sapiens
taatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggattttccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaagacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcagaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatg

SEQ ID NO: 331486 - DNA, 3862 bp, Homo sapiens
  misc_feature (3725)..(3725): n is a, c, g, or t
  misc_feature (3727)..(3727): n is a, c, g, or t
  misc_feature (3729)..(3729): n is a, c, g, or t
  misc_feature (3731)..(3731): n is a, c, g, or t
  misc_feature (3733)..(3733): n is a, c, g, or t
  misc_feature (3775)..(3775): n is a, c, g, or t
taatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggattttccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaagacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcagaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaatcagtaattttgtgtttggggtgtgggggtggcnanananancatgccccattgaggggtcaacttgacataaagtggagactntttcaaaatggctggtacatcctaaggagggttcgggaagcatatcctctctgccttttcatcagtgcttaggggtccagctgggac

SEQ ID NO: 331487 - DNA, 364 bp, Homo sapiens
ccaagccacctgacagttctgtgcaagaccttccctgtgcagctccatgtagtttcttgggaagtaagagaagatactcatttcttcagggtgaagctcactcaacttatgctccttgccaaagtcaccagttccaccttccctttttttagcaatgggatgcacatggagaccaccactgtcttttccagaagctcctcaatctgggttgccttagttcatcagtaatagtgttgaacatcaaagaataagtggtcaggatcctgccttgctcattccgtgagaagatccttgtaccttaagaaagcagagatacgggaagagcaaggtggctcacgcctgtaatcccagccctttgggaggc

SEQ ID NO: 331488 - DNA, 136 bp, Homo sapiens
acactgacaccatctattacaccacccctggaaaacagctcggaatttctccctatcatcaccatcatcctaccactgctgctactgatttattttactttatgggaggggtcagagaagtctttttttttttttt

SEQ ID NO: 331489 - DNA, 689 bp, Homo sapiens
ttgacatgtcttgaggttatgctggcagccctatgcagaggctcatgtcgtaaggaactgaggccacagtgaagatccagtgaggaagtaaggcctcttgtcaacagccacacacatacaacgggaagtggatcctttattcccagtcaagcctttgcatgatgtggccctgctagcatcttgattacagtctcatgagagaactcaaacaaggccatgcaactaagctgctcctgaattcctggaccacagaaacgatgagataataaccgtttcttgttttatgtcactaagtttagggataatttgttatacaatgatatagtttggctgtgtccccacccaaatctcatcttgaattgtaactcccataattcccatgtgttgtgggagggacccattgggagatgattgaatctttgggagtggtttccctcacactgttcttatggtagtgaataagtctcatgagatctgatggttttgtaaggtttcccttttcaattggttctcattctctcttgccaccaccatgtaagaagtacatttcgccttccaccatgattgtgaggcctccccagccatgtggaactgtgagtctgttaaacctctttttcctcccagtctcaggtatgtatttatcagcagtgtgaaaatggactaatacatacaagagaaaacataatata

SEQ ID NO: 331490 - DNA, 1146 bp, Homo sapiens
cgtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331491 - DNA, 1278 bp, Homo sapiens
cgtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331492 - DNA, 1282 bp, Homo sapiens
cccccccccccccccccccaacgagttcaggcaacgggcgggtttaatcggcacaggaggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331493 - DNA, 960 bp, Homo sapiens
cgggcagagcgacagaggatccccgtcggcatgcaagtgtcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331494 - DNA, 1035 bp, Homo sapiens
cgtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaaagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331495 - DNA, 751 bp, Homo sapiens
cccccccccccccccccccaacgagttcaggcaacgggcgggtttaatcggcacaggaggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagacaaaaaaaaaaagaaaaactcttttgtgcgggcgcggactcggcgccccggggaaagaagtgtttttaagacacccatctggttgtgggcgggcggcgggggcccccaggaggggatcaggtgtgcgaccatgggcgcacacagagggggtgcccaaaggagagaacccaggggctcacagacaagatagggtggtgcgggagttctcctcaaccaataagaaaaaaccgcccgggcggggagcaaccccgagaggcgggtttctgggaccaaaacccccaaagggggggaggtccgggagaggacactaaacggaggcgtcttatcaaccgggggaggtccccaagcgagcgcctcgtgatacctaaaatatagcgccccgcggtggggagaaacaccagccagacgcacagcgtgacagagcaggcacacacgagcaacatcagtaagaccgacacgtcgagaggatcgtagagacatacaccag

SEQ ID NO: 331496 - DNA, 432 bp, Homo sapiens
atacagttgataagtgttttcattatagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaaggtatgaaaaaatagataacttttgtcttaattttaaattatgatataaggaaaaatttgttaatactattatgaattctgccaattactgtaatctggggatagtataacagcactataaatgtttttgtatgtgaccatttgtttgacaagatccatgtgtggatgaaatgttaggaaaagggaggcccagtggcagtgggctcacacctgtaatcccagtagcctaggaggttgaagcaggaggatggcttgagtct

SEQ ID NO: 331497 - DNA, 1220 bp, Homo sapiens
cgtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttga

SEQ ID NO: 331498 - DNA, 1053 bp, Homo sapiens
gacgcgcggggccacactgcccgccccctagcctggcgctgggcctccgggacaagttggctgggtccgggcttggggactgcaacgcggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331499 - DNA, 1095 bp, Homo sapiens
cgtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaagagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaaag

SEQ ID NO: 331500 - DNA, 1578 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttaaaaaaaaacaacaaacaaacacaaacaacacaaaaacaagggg

SEQ ID NO: 331501 - DNA, 618 bp, Homo sapiens
ggtcccttacagcttcccaagttaggttagtgatcatcttcaactggccttaagaggagaaccagatggctgccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331502 - DNA, 771 bp, Homo sapiens
  misc_feature (630)..(631): n is a, c, g, or t
ggtcccttacagcttcccaagttaggttagtgatcatcttcaactggccttaagaggagaaccagatggctgccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttaaaaaacacaccnnaaacaacctccggggcatccattccggtcgcggaacaaagcggccatcgcatggcccgggcccacggtgtcccgaccccagttcttggcccaagggggcaatccccggcccccatgcgagccatatccgaacccggaccg

SEQ ID NO: 331503 - DNA, 399 bp, Homo sapiens
ggtttttataaatgtcttactcaagttcaaacctagacggggcagtgtcctccccagcccaggtgccactaggcacagcacaagagactaaaaacaacaggggaaggctggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331504 - DNA, 1167 bp, Homo sapiens
  misc_feature (403)..(403): n is a, c, g, or t
  misc_feature (408)..(408): n is a, c, g, or t
ggtttttataaatgtcttactcaagttcaaacctagacggggcagtgtcctccccagcccaggtgccactaggcacagcacaagagactaaaaacaacaggggaaggctggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttaaaanaacanaaaagacaactcagaggcaccaaaatgcccgcggacgcgagacaatacagagggacgacgaccacgcggcaccacgggctccacacccgtgctcacccgtgcacccagccctcccggacaccaacacggagcgcagacaccgccgcgacacccccactatacgcgcagcccgcgcgacgatacagtcgctggaccgacgcccgggcctgacccgcgcgcacgccgacgaccccggcgcaaaccgcgggagcgcgccggcgacgcgccccgcgccgcactcaccgccgccgcaccagcagcgcgcgcgccgagcacgcgcgacacaccgcgacacccagacgactcggggggatgggaagagtcggccgctgcgcctggtcgtgtgcgtcaggtgcggggctagccggtcgcgcgcgggacaggggctcggggtcgcgggggcggcggtggctggggcgggcctggaggcggacggccgcgcggcctgccgccgcaacgtcgggcggtgtggggcggtgcggcgggggcgccaggggacacgcaagcaccagctcccgcgcgccagccagacagcctccgttggcgcacggcgccaggtagcggcacgaccgcgcggcgcactaggccgcagccgcgatccgccgcgccgcgggcgcgaccgctgctcgcctggcgacgcacgccgctgccgcggcgggcgcggacaggggggccggagggcgaggcggcaagtgcgcaccgcggccgctgccgcgacag

SEQ ID NO: 331505 - DNA, 209 bp, Homo sapiens
tcgacccacgcgtcgcggacgcgtgggtcgacccacgcgtccggttctagatcgcgagcggccgccctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331506 - DNA, 1452 bp, Homo sapiens
gcggagcggagcggcggcgggcgcagctagcgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331507 - DNA, 1437 bp, Homo sapiens
tggcttctacaagaggacagaaccaagaggagtggcaactaattggatgtgggagaatccacaggagggagaggaggaaagggaacgtgttctgggaggaggcaatagccccttcctttctgggcacaggaaggtagccattctcctggccgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331508 - DNA, 1642 bp, Homo sapiens
  misc_feature (1545)..(1545): n is a, c, g, or t
  misc_feature (1552)..(1552): n is a, c, g, or t
  misc_feature (1555)..(1556): n is a, c, g, or t
  misc_feature (1558)..(1559): n is a, c, g, or t
  misc_feature (1562)..(1562): n is a, c, g, or t
  misc_feature (1571)..(1571): n is a, c, g, or t
  misc_feature (1578)..(1578): n is a, c, g, or t
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttaaaaaaataanaattcantgnncnncgntttacaacntctgaantgggaaaacccttgggcatacccaacttaaatcccttggcatttccccttttctcctgtgcgtt

SEQ ID NO: 331509 - DNA, 1426 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331510 - DNA, 740 bp, Homo sapiens
gagcgcaggaaaagtatgacataatgtgcgtgtctgggcggtcgtgcaagaccggatgccgtgtatagccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331511 - DNA, 1237 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccgatttgtactttttttttttttctaactgctaaaaccattctcttccacctggttttactgtaacatttggaaaaggaataaatgtcgtcccttta

SEQ ID NO: 331512 - DNA, 703 bp, Homo sapiens
cttcctgcttgtgcccgtcaccaagaccctgcttgtaacctacctgttcttatgaattcgaacagcataggctcgattcagtcacgaccaactcatacacctcctagtgaaaaaacttccataccactcaccaagacccctggcagaagcaggaagcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331513 - DNA, 1097 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgatccacaggagggagaggaggaaagggaacgtggctgggaggaggcaatagccccttcctttctgggcacaggaagg

SEQ ID NO: 331514 - DNA, 1535 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331515 - DNA, 687 bp, Homo sapiens
gcggagcggagcggcggcgggcgcagctagcgggtcggccgcggagcggaggtgcagctcggcttcccccggcacccctccccctcggggcagcacctccgcggcgcgacccgccgatatcccctgggggccggcggctccagagcgccccaccagcgagaacaccacatccagtgggcaagtccagaagctgccagagggtctccaccaggggccggactgtagacctgcctgaggtgagagcagaaaaggcagctatcccccgcgcgagagggccaacagagccagggaagacatgggcccatcgtcgaacaatcgtcaagtgcggagggactctattcgccgccaagagggcgtggcacaggcggcacgtcagcccacagctggtgcaagcgagacagcaggactcgaaggccaggcacaggagggccacacagtaggcgaatgaccagatcggaaggcccaggcagtctcccttagcccaggggttgctagacgggcccaacggcgggcaggttcccccccacaaagggtagaacgccccgaaggaaagaagaccgcgaaaattgccctttgcaagaaagccttttccaaacacttgaggcgcgcctgttcctttcagggaggacactcgcgaaggaagcgctgcgggggctggatactatacatggcgcttcggttaacaca

SEQ ID NO: 331516 - DNA, 1434 bp, Homo sapiens
cggcgcgtgcccggggcggttccacgctgccccccgagcgagacccccgatcgatgcctcagctgatgctcgatggctctccgtggcgacttgagctgtcgatggaggcggtcagcgcgccgttccctctcgtcgcatatgcgctcgatggcgctcagtgagaagttggccatggtttgagtgtgcgcttggtgaggagctcagtcgcggcatagggatgtaccgggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331517 - DNA, 890 bp, Homo sapiens
acagaggaggtggacagcacagaggaggtggacagcacagaggaggtggacagctggacagcacagaggaggtggacagctggacagcacagaggaggtggacagctggacagcacagaggaggtggacagcaaggggtggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttta

SEQ ID NO: 331518 - DNA, 1170 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccagatatgggagacatcaaggagatcaact

SEQ ID NO: 331519 - DNA, 488 bp, Homo sapiens
gggtttcaccgtgttagccagggtggtctcgatctcctgacctcatgatccgcccgcctcggcctcccaaagtgctgggattacaggcgtgagccaccgcgcccggcccagaaatgtcttttatagatggctttaaaaaatccaggacccatgcaaggttcccataaggtatttaaacttttaaaatatttatactgaatagatgcacaggtcctataatgctaacaagaggcaaaagacaaggaaagatttctctcacaattctactaccacagtttcaaaccaatttctttttcatctctctgttctttaaaaatgaagctttggacagattttctttagttcactttcctaaccatccatgagacaaaaaaagaacactgatcaagactgtggtgctgtttgactgcataagcacaaattgtggtctttgaaagttcttgctgagagatttggagttttattaagaataccaggaagccagcggc

SEQ ID NO: 331520 - DNA, 460 bp, Homo sapiens
gactgattccacaggtgggtagggagcatctgttgccagaaagcaagaaagcacttaaagaatgatgtggacatgtcaaagggacacagaagccagcctggatgagatcccactggccctaactgtccacaaggacaatttgagcaaggatgtcaacaatttaagagcagattataaaccactgaataaaacagaaaaatacaaagaattgaaacggacattgatggcagacaggatattaacataattttaaagtatctctccaaggaatgcttctgaatgatgaaggggaaaagaataactgtacagtggaaaagcctggtaaaacccaccttagtgaccaaagtgaatgtcaccatagtgggacaaaaggaaatcaagtgccaccttatgggattcaacgaggacgcagcatcccttgggtgatgttccagccaaatacacgtgcccggtggaatca

SEQ ID NO: 331521 - DNA, 284 bp, Homo sapiens
gcggccgcctactactactactgctcgaattcaagcttctaacgatgtacggggacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331522 - DNA, 3300 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331523 - DNA, 3507 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331524 - DNA, 2813 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331525 - DNA, 4865 bp, Homo sapiens
  misc_feature (11)..(11): n is a, c, g, or t
  misc_feature (2541)..(2542): n is a, c, g, or t
  misc_feature (2550)..(2551): n is a, c, g, or t
  misc_feature (2570)..(2571): n is a, c, g, or t
  misc_feature (2708)..(2708): n is a, c, g, or t
  misc_feature (2909)..(2909): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttnntgtggccnntatttttatttctttaatnnttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccanattcaaaaggttatataccaagcttgtccaactcgcagctcgtcggccaggacatgcagcccagaatagctttgaatgtggccccaacacaaatttgtaaactttcttagaaattgtaattattattattatttttttttggtaactttttttaaagctcatcagctatcgttagtgtattttatgtgtggcccaagacanttcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331526 - DNA, 3258 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331527 - DNA, 3659 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331528 - DNA, 3110 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtatgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331529 - DNA, 3834 bp, Homo sapiens
  misc_feature (11)..(11): n is a, c, g, or t
  misc_feature (3817)..(3817): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaatcggatgtcttgactctgatgtattttatcaggttgtgtgcatgaaatttttatagattaaagaagttgaggaaaagcaaaaaaaaaaaggggggggctaagatcctgggggcaagttacgtcccgttttgtacagggccaagggcgatataaaagggcggggttaaccccggggaagggtggttcgaggcccttgggcatgggacccccaaagccggaacaggttggccgccgtgtgattaattacataaccngcttatacttacaccac

SEQ ID NO: 331530 - DNA, 4349 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaatcggatgtcttgactctgatgtattttatcaggttgtgtgcatgaaatttttatagattaaagaagttgaggaaaagcaaaaaaaaaaaaaaaaaaaaaaaaaaaaaaaaaaaaaaaaaaaaaaaaaaaaaaaaaaaaaaaagaaaaaaaaaaaaaaagagaggagagagagacaaaaaaagaagaggagtgaggaaaggaggggcgagcaacatcacttacggggaagcaccaaatatcggaggaacagcggggggccactatataatggagagagaggggtacatatatatataacgggagggcgaggggagaccgcgccgtaaacaaacggagtcgagagaaggggaaaaaaaaggttgcaacaaaagggggacacacctgggagacagaggagacaccaaaaacacgcggagagagggggcaggcgcacccctatatgtgtgggccgagccacacgacaaaacacaggaggagacaaaatataacaagcccccacggaggggagggacaaatccacaccgaccctgccggaagcgtcgcctaacaacacgggcacgaaacacggatcaccacagcacagaagcatcagcacgaagacagctagatgaaaaaaagagagtggagcacataaggaggaacatcgctggcagcccgcgagacaactaatatctacgcgaggaggaaccagcagtcataacaagcgagcgacgcagagccgcgcaggaacgaaacaccagcagaaaaaacagaccaacgagacccaaagacgagagaagagagaat

SEQ ID NO: 331531 - DNA, 3740 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaaaaaaaaaaaccaacacaaacacacaccacacacaccaccacacacgcgcacaaacacacaacaaacacaaccggagaaacgccaccaccgagccacccacaccacgacgaccaagccgcgcacacaaacacacacagccgcacacacacacacacgccgccgccagaaccaccagca

SEQ ID NO: 331532 - DNA, 3511 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331533 - DNA, 3466 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcaaattcaaggggatcctcaagagcg

SEQ ID NO: 331534 - DNA, 3747 bp, Homo sapiens
  misc_feature (11)..(11): n is a, c, g, or t
  misc_feature (2541)..(2542): n is a, c, g, or t
  misc_feature (2550)..(2551): n is a, c, g, or t
  misc_feature (2570)..(2571): n is a, c, g, or t
  misc_feature (2708)..(2708): n is a, c, g, or t
  misc_feature (2909)..(2909): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttnntgtggccnntatttttatttctttaatnnttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccanattcaaaaggttatataccaagcttgtccaactcgcagctcgtcggccaggacatgcagcccagaatagctttgaatgtggccccaacacaaatttgtaaactttcttagaaattgtaattattattattatttttttttggtaactttttttaaagctcatcagctatcgttagtgtattttatgtgtggcccaagacanttcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggctt

SEQ ID NO: 331535 - DNA, 1796 bp, Homo sapiens
  misc_feature (11)..(11): n is a, c, g, or t
  misc_feature (1750)..(1750): n is a, c, g, or t
  misc_feature (1788)..(1788): n is a, c, g, or t
  misc_feature (1795)..(1795): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggagggaaatggggttttgcaaagtgtccctgtgtggtgaagtgcaaacccccaaactanaactgggcaaatgcaatggttgactggttcctttgggntaaccang

SEQ ID NO: 331536 - DNA, 1052 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgtaagtgcctggttccttacatagtgaatgtgtttatgttggattttaatgtttaatactaagagcttgtggagtcggatcacgcgtcgacgcggccgcgaatttagtagtagtaggcggccgc

SEQ ID NO: 331537 - DNA, 997 bp, Homo sapiens
  misc_feature (11)..(11): n is a, c, g, or t
  misc_feature (920)..(920): n is a, c, g, or t
  misc_feature (938)..(938): n is a, c, g, or t
  misc_feature (951)..(951): n is a, c, g, or t
  misc_feature (989)..(989): n is a, c, g, or t
  misc_feature (992)..(992): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaattatttttttcccattgaancccttatttttgaataanccctcctttggcnccccctgttcccaaaacctggaatttaaatttattttnccnaacca

SEQ ID NO: 331538 - DNA, 841 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccacgctctgcaaggaacccatgcgcgtgggttccttgcagaggcaggaggacgaggaggataaacccaggcaggtggaggtgcatcaagagcccggggcagcggtgcccagaggccaggaggcccctgaaggcaagggcagggagacgggggagaatcgtgctcccctggctttggaccctgtgctcagagctcctgggggtcggcctggtccatcccaggagcttaaccagcgctccc

SEQ ID NO: 331539 - DNA, 237 bp, Homo sapiens
caaccaaaaccgttcccaacttctttcctcctcacagggaaaggcaaaaaagtccgcaggcatagagagtggaaagaaggaacagcatactaggctggtttgaaaaacaatcaattgctaggtaataatgtcttaccttttgagtggaaggaggagctgggaagaattaagttcgggcaggttttttgctcattttggatcagcccttcatattatggcttaatagctttgtttata

SEQ ID NO: 331540 - DNA, 494 bp, Homo sapiens
gtccacctaccttggcctcccaaagtgctgggattacaggtgtgagctaccacacccggcctattccacatttttaagactcctcctaattagtaacagccctctgcactgtgtgatcctgagtattttaactcagtgattaaaacaggaatactcttttcaattgtgtattttattttaaagatttgatccttattaattaaaacctgtttctctggcctctgtgttttctagttactcaattggatttggcttgtagatactttattgaaatatatttttttctgagcagtttatccattggttttatgcattcaagtagcattttgtttgacttttcctgtgtataattaggcattcttttagtccctttcctcagaagtcattttggaaaacggcaaattgtcagaaggagtaacaataagttacaaatcttactgcaagaacggggtgaatggaacaggggaaaatggaagaaaatgttccaatatttc

SEQ ID NO: 331541 - DNA, 3561 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331542 - DNA, 3456 bp, Homo sapiens
gcacgagcaacccttcttttttaaggcttctaaatcatcacatcgtgcagaagtaggcattccttcctgtaaaaatgttgaatttgtgcaccacccacaatttggccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331543 - DNA, 3507 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331544 - DNA, 3507 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgactttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331545 - DNA, 3642 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331546 - DNA, 3642 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaatcggatgtcttgactctgatgtattttatcaggttgtgtgcatgaaatttttatagattaaagaagttgaggaaaagca

SEQ ID NO: 331547 - DNA, 4268 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaaaaaaaaaaaaaaaaaaaaaaaaaaaaaaaaaaaaaaaaaaaaaaaaaaaaaaaaaaaaaaagaaaaaaaaaaaaaaagagaggagagagagacaaaaaaagaagaggagtgaggaaaggaggggcgagcaacatcacttacggggaagcaccaaatatcggaggaacagcggggggccactatataatggagagagaggggtacatatatatataacgggagggcgaggggagaccgcgccgtaaacaaacggagtcgagagaaggggaaaaaaaaggttgcaacaaaagggggacacacctgggagacagaggagacaccaaaaacacgcggagagagggggcaggcgcacccctatatgtgtgggccgagccacacgacaaaacacaggaggagacaaaatataacaagcccccacggaggggagggacaaatccacaccgaccctgccggaagcgtcgcctaacaacacgggcacgaaacacggatcaccacagcacagaagcatcagcacgaagacagctagatgaaaaaaagagagtggagcacataaggaggaacatcgctggcagcccgcgagacaactaatatctacgcgaggaggaaccagcagtcataacaagcgagcgacgcagagccgcgcaggaacgaaacaccagcagaaaaaacagaccaacgagacccaaagacgagagaagagagaat

SEQ ID NO: 331548 - DNA, 4231 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaaaaaaaaaaaaaaaaaaaaaaaaaagaaaaaaaaaaaaaaagagaggagagagagacaaaaaaagaagaggagtgaggaaaggaggggcgagcaacatcacttacggggaagcaccaaatatcggaggaacagcggggggccactatataatggagagagaggggtacatatatatataacgggagggcgaggggagaccgcgccgtaaacaaacggagtcgagagaaggggaaaaaaaaggttgcaacaaaagggggacacacctgggagacagaggagacaccaaaaacacgcggagagagggggcaggcgcacccctatatgtgtgggccgagccacacgacaaaacacaggaggagacaaaatataacaagcccccacggaggggagggacaaatccacaccgaccctgccggaagcgtcgcctaacaacacgggcacgaaacacggatcaccacagcacagaagcatcagcacgaagacagctagatgaaaaaaagagagtggagcacataaggaggaacatcgctggcagcccgcgagacaactaatatctacgcgaggaggaaccagcagtcataacaagcgagcgacgcagagccgcgcaggaacgaaacaccagcagaaaaaacagaccaacgagacccaaagacgagagaagagagaat

SEQ ID NO: 331549 - DNA, 3271 bp, Homo sapiens
  misc_feature (11)..(11): n is a, c, g, or t
  misc_feature (3251)..(3251): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatataangaggggccgagctcgattca

SEQ ID NO: 331550 - DNA, 2429 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaaggtggttcctaaataccttttagtttaaaaaaaaatgcagataaaggctacctctgaattctcaatagattcatcatgtttgctcttaagtgtagctgtccacactgaaaacagccaatatgttgcctgaataaactgaattgtgaacatctaaaaaaaaaa

SEQ ID NO: 331551 - DNA, 1388 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgagtcaatttgaaatcagcataacctcaaatcaccgagccattacgacctatgaccagctttaaaattaggccctctgggctattaccggaggacagtacgaggcagaccggtcagagtagcaggcaaccggacag

SEQ ID NO: 331552 - DNA, 801 bp, Homo sapiens
  misc_feature (11)..(11): n is a, c, g, or t
ggacctgatcnagtttcaagtttttgctggtgtggtttggctccaaaacagaaatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttattctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 331553 - DNA, 150 bp, Homo sapiens
caatgccattctctcaccattgcttcagtggtatcttggatcacacagccaggccaaagaggcaaaggttctctctttttttttaaaacaaaaccccaaagagcttctacagaagcctccagaagcccaactcccactgtggtcacagcc

SEQ ID NO: 331554 - DNA, 138 bp, Homo sapiens
tatgaaatcaataattatttcgagaaagaaaacattattcatatatgtgtaccgattttattttccatacttttagagtgctgtattgcctgtggactttaaatatttaaattcctagtctgttattaatactaattt

SEQ ID NO: 331555 - DNA, 147 bp, Homo sapiens
ggccaagtcactggaaaccaggctcttaagtttgagcctggaaaagaacacgtgggactctgaagaggcggtgccaggacctcagagtgacagggcagggtccctgcacacaggggccttgcagggaaaagcacacatcttctgttg

SEQ ID NO: 331556 - DNA, 375 bp, Homo sapiens
tggtacgatctcagctcactgcaacctctgcctcccaggctcaagcgattctcctacctcagcctcctgagtagctgggattacaggtgcctgccagcacgctcagctaattttttgtatttttagtagagatggggttcaccattgttggccaggctggtcttgaactcctgacctcaagttatccacccaggttggcctcccaaagtgctgggattacaggcatgagccactgtgttgggcccatacttgagaatctttgattggatgtcagacattgtgaattttaccatgttaggtgttcaatatttttgtgttcccatagccttttttgatctttattatgggatagagttaaattacttggatatagtt

SEQ ID NO: 331557 - DNA, 580 bp, Homo sapiens
cctcctccctaccacctaaacctagtgctccacactctgtcctgcatgaaatgtcacctgtcagtttataaaatggaagacaccttctatgcacatctcatgggttaattcagtgccaatccccttgagtgccagtctctgtgcactgtcattctttaaagggtcttgctatggccaggtggtggtccctttaaatagccatcttggcatccaggaagtttctgacactccctaatgtgacctctccctctatctggctcttttttgattcttttcacatcccatgagtttcccactatcctctactgcagtgggagcactctgctgctgtggcaacagccattccagcatcagttgataaaaccagtatgtgcagaatggttcctcgagtgattcctaaaaagagaaggacctgccctgtcacattatctccaaacccagccctgagcccctcccactcggccatttaccccttctctagaatgacaggcttcaaattgtcctctgaagagagattctaccatcaatgatcaatgaagaggttatgtgatgagggagaggcctggctgggcaggcagtg

SEQ ID NO: 331558 - DNA, 334 bp, Homo sapiens
cttttgggtataatttgttaaggcctctgtatgccatataacacgttcaatagctatttatggtacaaagacagaagctaagtgatcataccattggaatacagaacgtgtccagcaagactgtaagtgaaaaagcgttgctagtttggcagggtctgaattactcatcctcgtgcccaagcttaatctagggaacatcatcttaaccatcctgggggtaatcaaggccataagttaaagcaacatagccaatatgtcccatttactgctagccaattaatatctggtcactgtacccaataggtgtcatgccagtgccttgtaacgtaataat

SEQ ID NO: 331559 - DNA, 289 bp, Homo sapiens
aaatttgaaagaaaaatggtatttatcatcagaaaaaataaattattgaaaattacaaaagaataatatgtgcacctctatttggaaatatatgagactagagatatttttgaaacaaaattaaataatagaaagcagaaagtattaactgttcaataatactggaagaaataacaaaaatcagttaactttcccaaagattgcagagtcaaatggtcttaaagagtagttattttaagccattaagttactactatttccctcagtatattcaatttttgaaagtata

SEQ ID NO: 331560 - DNA, 1537 bp, Homo sapiens
aggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaaa

SEQ ID NO: 331561 - DNA, 525 bp, Homo sapiens
cttcctatccatgtatccattaggatcttctttgatatccttcctcagagttttctaattttcttcatatagatcttgtaaatattgtttttaacacttcaaaatacacttttcaaaaagtcttaaacagtgaagatttttaaaacattacactgaaaaatagtatctaaacaacactactgacccaacgtactaatactatgtcccttttgaaactacctatcaactaagaataatttagtaaaattcccatattccttgtagcagtttgaaactgtgactccaaatttctttgacgctcctccctcccattaagagctgaagtctgtatcctgttctcctaaaatcggagctctgtgattccttgatcaatatgagaaagttaaactgaggttatgtgtgtttccagcatcagaccttaagaaactatctgttttcactccctgtctcttagaatattgtttcttaggatgtttcacttttggaacccagccaccaagttgtaaaaaagaccaagctgtccca

SEQ ID NO: 331562 - DNA, 453 bp, Homo sapiens
tgagagaggtggctaagcttattttttaagtcattgggcaggatttctgccatttgtacctgaaagggtttgatacgcaatctcaatgaaagcaggatgactgatactcaggatcagcttctggctatgttttccaaaggaaagctctgtcttgcatgctcttttttctacccaagagccacccaactaaacctggcatcagcacagggactaagctgaggacattccatcttcccccaaagtggaagtgctcagaggaatattaacagtggctttatctagtctaattggccaaggcttacagttcttcaagaattccttccttgagatggttggccttctagatctgtggtttttaagtactggtctgaagacccctggtaagccaagaagatccccaaataaggttagcaattacggtttctttctggccttcattccatgccacactgt

SEQ ID NO: 331563 - DNA, 229 bp, Homo sapiens
tgaccttcaccaatgtctctctgtgtctggattcttctctgcctgaagcaagtccagagacaagcccacgagaggggcaggtggatccacaggttaccggagatgccacagctgtagggtgggccacattgagctcctccttctgcaggcagaggtgtgtccccctcatcaccctccatcaggacccccctcaaactgttctctggccactttcaggcacacagctctc

SEQ ID NO: 331564 - DNA, 465 bp, Homo sapiens
aagcgaaaaaaggaaggagcatgtaggatgccatggacctggtctaaaaatgacacacagtactttctctaatattccactggctggatttcatcttaatgggtatacctaactgcagggaattcatacctaactgcagcgaattcatacctaactgcaaggaattcatacctaactgcaaggtaatgtttagtggttcatccaagaataaaaggaaaagggtctagtaaacagtggttagcctgtgccaaaaacttccatatatacatgcttgtaaacaataatatttttagtgtttctgcccatactcaaggaaaaatttaagagtatatacaacagtctttgctctctagaaggctacaggttactatggattatagatgttgggaggaggtggaagtagtctatttactcctactcttcttaaggtattatttttactttgtaatagataggggaggggag

SEQ ID NO: 331565 - DNA, 248 bp, Homo sapiens
gggggtccccaccgcatgaaggacaggaccaaaacccagcagggtaatcaacaccctgcctctgtcatccaggaatccataccctaacctttttacatctctcccaccccatccatcactcagtgctcccagaacacatagccccactgcatgccctccctgtggtgaacttcttttcatcatacaaagcccagctaaaaagtcacttcctcaatgagtcctttccccaaggcatctccatggccacc

SEQ ID NO: 331566 - DNA, 452 bp, Homo sapiens
tggggtgtgtggggaagggaaaaatggaggcaggggtcccccagagtgaccagcagagggcagccccactgcggggaagaagggcccccaaacaactccatggacaatgtggacttcaccgcacctccccctgaacgaccccacagagccacaggcctcaacgacacttccctggatcccctggaagcctggcttgtcagagttggaggtagtcccagggaaagctaacaccctcacaatactggtgaggcccaaagagggaagccactcagctaggaacaggggctggttccagatgccagccttttttcgtgttagattttccagctgggctaggttcccctcccacactttccttcctgggacctccacacacaatgtctgagctatcaatagcaggacttggttgattgtacgaagcccaaatcatgtgcccccccctccaggaaggt

SEQ ID NO: 331567 - DNA, 380 bp, Homo sapiens
tcagtcctgttttacagtgttctggcgcacatgggagagagagattggtgccatcttccccaggctaggattggcaaggagaatgcagcaatagaagttaggtgaagcaagggtatccacgagagcatcgctgcagtgattggtcaccaggtccacgctggcagagcagctgagaggctggaggcaactctgggccaggaaaataggaggaaccaacgaaccagagatcatgttgaggaagagcaagctcaggggtgacagattgagaaaagtgggaagacaggaaactgagtcaaagtctagggctcaaatatgttctaaatggtggtgagatccaagctgcaacctacctaaggttaggtaacattagggaggcaatg

SEQ ID NO: 331568 - DNA, 330 bp, Homo sapiens
ccccttcatggcaggaggactaggagggtccaataaggcagtttaaacattgatgatgtcatcatggccatactattaaattttgtaaaaagcaaacagcaaaggtttccaggaaaactgatttttaaatcctagcattaaacaaaatagtacaacctcgctttatactaatatcaaaacacacttcctcctgcccacggagggtccctcctgatggggacttcgtcttacctttctttgaatccccaacaaagcacctggctccatgagggttgtctccaggacaactgaatgatactctgaaggggggatggcaaagctaactggccc

SEQ ID NO: 331569 - DNA, 425 bp, Homo sapiens
aagatttgtgaagctgtgtgacctgcctccttgcaactgccagagctgctcaaagctccaagattccctgctgggcagccacatacctgccaaagcattgtgttcaaggctctcaagaaaccagccatgaaaagcttcccacttcaggaaaaatcccttgcttgacttattcagagatcatggaggccaatacaactgcagaccagagaaaaaaaatctggctttgttgctgttaaaactcaattcaaagactcaggctccttgagatccctgcagggtgattttactattttcccagaggtaacccaattggagtctatctgactgtgccagtccagatattcatattttgtctttttcctctgtcttatcactgggggaaacagcttggaatttaggttcatgaatacaacctccttactgtt

SEQ ID NO: 331570 - DNA, 393 bp, Homo sapiens
ctggctcgagcgtggtggctcacgcctgttatcccagcacactgggaggtagaggcaggcggatcacttgaggtgaaatcaagttatcaagtccctgtgataagtcaaggttatgttaatagtcagttaactgggctctccaacagtctcagcacagggccagtaacaggaaaaatcaagtgattagagggtatgaactttcagccccaccacccatagaccaattgctgaacacatgaaagtgctgggagggtagtacacccagacagggcatggaagctccacacaccacaccacctcccctcacctaatacctcaccattatcaatctattcacctgtatcctttataataaaatcagcaaatgtgtttccctgaattctttgagccatc

SEQ ID NO: 331571 - DNA, 596 bp, Homo sapiens
ccccatgtacctacccattctcagcttccccagttatcagctcagagttctctcacttttactttgacccattcctgctgagattattttgaatcaaattcaagataatttttttttgtaaacatatcagtaagtatctctgaaagttgaggcctttttcttaacttttaatatgaaaattttccaacaaaataaacacttgtataatttttacctagattcagcagttaacatttttgccttatttgctttatctctcctctgtatatacattttattctgaaatatgtttgaaaataagttacccacattataacactttacccctaaataacttggtatgaatttcttcagcataaggacatttacttacctaaccacaatacaattatcatgctaagaaaatgagcagtaatccacactgttacctaaatccgttgtactttaaagtttcccaaaatgagatggtgttttaaaataagaaataactaggatattagtggaggaggttgtggtgaggaactatagccacaaaatatgtatgtgtatatagtaatcttgtggctgagattgagccactgtactccagcctgggt

SEQ ID NO: 331572 - DNA, 222 bp, Homo sapiens
actatataggcaatactagggtaaatattttacatagattaccttatttagtagctcttagctgctaaaaaaaaaaaaaaagataaagatgtccagtctagagtctcataattgtatggtaaacactaaaatggtggtatgatccagttgccatggaaacacaggggcggggccctcagctcagtttaggaaggagcagattactgagtggtgtctttaact

SEQ ID NO: 331573 - DNA, 249 bp, Homo sapiens
gtgcattctttcatttgtctcacagtcatcttcagaaagaacttgtgattccattgtgcaaattgggaaacgaaggttcaaagatctgtcaacatgaccaaagcaacataaactagtatgtgacagagctggtattctaacctagatctcatctaatgaaaccataactgctgcaataaaactggtgctgcagctctgaaaaagggtaaaaatctgatctttccatttaaaagcaatttaaacgtatcg

SEQ ID NO: 331574 - DNA, 346 bp, Homo sapiens
ttccctttgattccaccattccagtccataaatcaagttcatttttatgtgttgttttttagttcttgatgatgtaacttatatctttttttcagttttgtgtttcccatttagcataaacattcttagtaacttcagctatacagttctcatttgcaaggatcacataacattctatcaggttgttttatcttaatttttaagtttcctatcatttttggacattcgagttgtttctaattgtttactgttgtaaagccgcagcgaatgtctttgcacacaagtatttaccgaggacacactcacatcagaaggctcaatactaagttagagggagcttgctctg

SEQ ID NO: 331575 - DNA, 520 bp, Homo sapiens
agaacaaccagatatatgaagcaaacattgatagaactgaaggggaaattaacaacaacaacaacaacaacaacaacaacaacaaaaacaagaccaaggaactttaatacttcactttcagttatgaatagaacaattagacaaaagatcaataaaggagcaggacttgaacaacactatagaccaattggacgtgacagatatatatacagaacgctccacctaacaacagaagaatacatacttttttctagtgcacatgaaacactctccaagatagatcacatagtaagtcttaatacacttaagaagactgaaatcatacaaagtatcttctctgaccacagtgaaataaataaataaatgataaatgagtcaagagaaaatgggactaaggtacaaacaggcgtttctcaggataggaaacccaaataggcgctgagcatatgagaaatgcttgcgcccattagtaatctacgaaatgtaagtggagccatatccttcaggtggggggagatgt

SEQ ID NO: 331576 - DNA, 381 bp, Homo sapiens
caccattggaattttagagcctaaaggatggtaaaggggggtttaggaagcagagctctgttcctggtttagccagtagccccatgtggcctcaggcactgcgccttccccagcttcagtttccctgctgtaaagtgggtgatctccatgtcctccagccctttgagttcccagacagagagagcatgaggaccccatgaggggctcagtggccaagtgaggggagttaatggagccctttctggagggagtggggaggcaactattgggggtaaatggtgtttccctactggaggtggtgacagatgggtggggcccagggtctaggttgtaaaggagggctgtggggcctctgggaaatctggaccagaaatgttggga

SEQ ID NO: 331577 - DNA, 358 bp, Homo sapiens
gctgggtggaagaaagttgtgcccactcagagcctgctggtctctctcttctccacacttcagtgctatttataatcctctttaaatgcctcgaattcctggtccagactcacctgaggggagttcctgatgtgggggggtggggtgttggaagggggcagcggggaagcctcccagtctccccagaggaagtgagctgcctttgaaatctctgctggaagggaatgagggcgtgtatttgcctcctccagtgatccaggcaccctcctcaccccacccaaggagcagtaggtactctcaaagctggcaattaaaattccagaaccctccctacctgaggccttgttctctgccccag

SEQ ID NO: 331578 - DNA, 3294 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331579 - DNA, 3351 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331580 - DNA, 989 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccagtgaggcgggaatgcctggttgcagaaagagctcgcaagagccaccaaaggaccctctaccagtcgaacaggatgatgccattgggggcattgtggaggaaccttttgacacaacaaactgctggagcgcttctggaatctataat

SEQ ID NO: 331581 - DNA, 803 bp, Homo sapiens
  misc_feature (779)..(780): n is a, c, g, or t
tatgagaggccatgtgctatacattatttaaatatgtagtatttaatattattagtaaattagtaattactagtagatcaataagtagtattaactcagtctggaccaaaattaattctaggtttacttttaaactattaagataaatataggccattattgttagaacagatgaaattaatgcaaggaccaactttaagcagtctacacagattttgagtactttttgagaaggttgcactgcactctaatgcaactgtaactagaagaataaaatgataatagaatcttagttgacctgggctaggagtccagtttagtttatgattggctccacctgtctttaaggatgagtgtttccccatgaattaggcatttggagtgttcgcgcatcttgagctcttgggatgagaatgactgggtttgacacagggtgcttgtcttgcaggatgcacatgatggggaagtcaacgctgtgcagttcagtccaggttcccggttactggccactggaggcatggaccgcagggttaagctttgggaagtatttggaggtgagagcctgctgcatgttctcagactgaaaacttgagatgatgcacccttgcactgcagaaagaagctgtgttgctggcatctggttgaccttgctttcaggcactgtgaattgttcattttctcaaaacatacattttatgtaagggatcgtttgaccaaagcatcgtacatctcagttattctttacttccgagtggatgtttgctctcattttctttaannctagtaaccttgttgctgtgagg

SEQ ID NO: 331582 - DNA, 3350 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331583 - DNA, 3676 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactccatgcctcttggtgattattttattctcccttatccttagaaaggggaaagaaagtgatttctttgtttacctggtagttatttgtaaacaacggctagtactttttaacggtctctttttcattcatcatgtaagctccattccacaaagtatctctctctgtaaacaccagtgttccagtttcatgtcgcgcaaatcttaacggacattggaaagatgtttcttcagaacattaccagctgcagtagaagagcccagcacggattgctcttcagccctctgcacggagcctctctccagtgaactgccgcagcagagaggcattc

SEQ ID NO: 331584 - DNA, 2249 bp, Homo sapiens
ccggtttagacctcagtcggcgctgtgagggcactgtccgcccacctgctcggctggctgagctaggtcagtggagagaagctggggccactcacacagcacagcaggccacagtctacagagtacgccaggtagagcggttagagtggcagccgctggagaaagggttatagaaacacatccctgactctttggttatgtcccacgtcctctgtgtctccttccccttccctactctccttcctttctgcctccctgtctcccttggaagtccctgttgtcagtgcatttcagtgcattgacgtgtcctaaacactgatctccacacaccttcttttatcttccacctgataggcaggccccagacccccttttttcctagctttgttctgcccacacaagcccacctggctagttggaacccagataccattttccttcagaacctctctccctgtccttgggcagcagcaactgctcccagacctaaccagtgctgaccaccactgcccggctcttcagaggcatgtgtactgtctttccagctcactcagagctcctctcttagggagagtgtgataaggcctgactgccagaggggccaaactcccttcatcccagcatgacttaattaagtacaccactggattttttctgaggtcttttgcatgttagtgagctcctgccttgtcgcgggcacagtgccagagagtaaaatggaagttggaaaaattaggactccctgaatgcacaagcttctggtgtttggtttaccaagatctcatcccaaatgttctgaaacttggtgcttttctgatctctcctttgaagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331585 - DNA, 2775 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331586 - DNA, 447 bp, Homo sapiens
aagaacaaacattccttcttgggaaaaaggccacagagatgctgaattgggggtggggaattgacaacctttcttttcttactgtcttctgtagccctgatggcagttacgtggcggcaggctctgctgagggctctctgtatatctggagtgtgctcacagggaaagtggaaaaggttctttcaaagcagcacaggtaagatgaaccctgtctcagccccccgttgcgttgtgagcaaggcctttgacttcatctcaggggtcatccggtttagacctcagtcggcgctgtgagggcactgtccgcccacctgctcggctggctgagctaggtcagtggagagaagctggggccactcacacagcacagcaggccacagtctacagagtacgccaggtagagcggttagagtggcagccgctggagaaagggttatagaaacacat

SEQ ID NO: 331587 - DNA, 322 bp, Homo sapiens
ccctgttgtcagtgcatttcagtgcattgacgtgtcctaaacactgatctccacacaccttcttttatcttccacctgataggcaggccccagacccccttttttcctagctttgttctgcccacacaagcccacctggctagttggaacccagataccattttccttcagaacctctctccctgtccttgggcagcagcaactgctcccagacctaaccagtgctgaccaccactgcccggctcttcagaggcatgtgtactgtctttccagctcactcagagctcctctcttagggagagtgtgataaggcctgactgcc

SEQ ID NO: 331588 - DNA, 312 bp, Homo sapiens
gctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtgtgagcggcgccggtgcgggctgggagtggggcgggcgggccccgcggaggcatgcggggcgtcagcgggaacctgaggccgagtccctggcgccgcccgcacgcatggcggccgc

SEQ ID NO: 331589 - DNA, 304 bp, Homo sapiens
tccatgtgtttcatgtctcctcctttccactcatagtgcctgtaaccgcagctgctggagacacccgaatggtttattggctttgtgaacatgtttctggagttatggtttcattgcctaattggaaaggtttggagtctcatttttccccctccgttttttgcacattctcttcatctgcctggtttgccaatttagtcccggacatgatggcacatggaatgacaatcagctacaagaaatggcccaactgaggattaagcaccaagaggaactgactgaattacacaagaaacgtggggag

SEQ ID NO: 331590 - DNA, 4292 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgtaagtaggcaggtttgggccagggaaaagacagcttgaggagcaatatgaaggcacatctgtggacatgacaaagaatgcagtcagatgcacccaaccccttaccccttttctgggacacccagcgtcgaacacaccacagaggtgtccagtctttctcagttcacctctgcttaatgggagggaagcagaacacgggtggcttcaaatgcttctaaatacaaaaaaatgtagtggcttactcaaatatggacagtgaaaccttattaagcagaatgattgtttaggtttgatcatcctgtttcattcttactagggcttccccccgcccgcaccgcccttcaagagtggggattggttactaacagtcagaaattgtgaagttagttagccaggaattgtgaggttagttgtctaatgctttatttccagggaaattaatttaatactagggaaccttgtttcttttgaaacttctaggctgggttttccctttcccttcccactgttttctggcagtttggtactgtgttgggtttctcttggctggggtttgggaactaagtgggaaacatattcccagttacctgtttttgtgggctgtttattgattgattatttgggcaaaatgtttctaaggtttaaacctatcctcccctcctctttagtaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331591 - DNA, 1837 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacgggtaagacccagttaagaaagttagtgcaatctccaaacttcatgtggtgttatcaaggcacaaactggcaggtgcttaattaggggactttgttttcccaaaaatcatgcttgattcaccctgcccttcctttcctccttggggaaatctgtgtttccactttatactctttgtccaaaactcagtttcaaaatatttgcaatgggaccctcacatttgcatgaaaaccttggaatactcttcataaggactaaatactttggtagatagcaattttggcttaatggcacagaacttagcaacagcatgtgaattgtgattcctgtgggctctaaaacctaattacctaaagtgggatatagaagtacaaatggatgtatcatagggataagacaattctgaaacaaaaactccaagctgagaaagaggggacaggtgtcagagcagggagaaatgattggatgttgaggaaagctgcatttgaaccaaaacttgccaagaattctcttggcatctgacagagagaccaaaacttggttgtatcatttttgattggggcagggggcggagggcgaagcatgtaacttaatttgcagacattttttttccccataagcctgaaggaatcatcacataagcttattaaatacaagctattgaaagatataatggaggatgaatttggcattagtaggcattttacta

SEQ ID NO: 331592 - DNA, 4343 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgtaagtaggcaggtttgggccagggaaaagacagcttgaggagcaatatgaaggcacatctgtggacatgacaaagaatgcagtcagatgcacccaaccccttaccccttttctgggacacccagcgtcgaacacaccacagaggtgtccagtctttctcagttcacctctgcttaatgggagggaagcagaacacgggtggcttcaaatgcttctaaatacaaaaaaatgtagtggcttactcaaatatggacagtgaaaccttattaagcagaatgattgtttaggtttgatcatcctgtttcattcttactagggcttccccccgcccgcaccgcccttcaagagtggggattggttactaacagtcagaaattgtgaagttagttagccaggaattgtgaggttagttgtctaatgctttatttccagggaaattaatttaatactagggaaccttgtttcttttgaaacttctaggctgggttttccctttcccttcccactgttttctggcagtttggtactgtgttgggtttctcttggctggggtttgggaactaagtgggaaacatattcccagttacctgtttttgtgggctgtttattgattgattatttgggcaaaatgtttctaaggtttaaacctatcctcccctcctctttagtaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331593 - DNA, 3243 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331594 - DNA, 3316 bp, Homo sapiens
gggcgggtcttccggccctctcgaaaatcatttccggcatgagccggaagaccgtcccggatggcctcggggacggccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 331595 - DNA, 865 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccaca

SEQ ID NO: 331596 - DNA, 1814 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaatggagtctcactttgtcgcccaggctggggtgcagtggcgtgatctcagctcactgcaagctccgctcccgggttcacgccattctcctggcctcagcctcccgagtagctgggactacaggtacccgccaccatgcccggctaaatttttgtattttttttttagtagagatggggtttcaccgtgttagccaggatggtctccatctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagttagtatcgagaacaagggaagaactggtttcactctgcacttctgatctttacaacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaaatt

SEQ ID NO: 331597 - DNA, 1328 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaatggagtctcactttgtcgcccaggctggggtgcagtggcgtgatctcagctcactgcaagctccgctcccgggttcacgccattctcctggcctcagcctcccgagtagctgggactacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaaatt

SEQ ID NO: 331598 - DNA, 716 bp, Homo sapiens
aatggtcactgcttaatatgattaactttttttttccattctcattttacagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccaca

SEQ ID NO: 331599 - DNA, 1672 bp, Homo sapiens
cgcgccccgacgtcactccgtctcgccctgccccggcggggggtcaggatcctccacagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaatggagtctcactttgtcgcccaggctggggtgcagtggcgtgatctcagctcactgcaagctccgctcccgggttcacgccattctcctggcctcagcctcccgagtagctgggactacaggtacccgccaccatgcccggctaaatttttgtattttttttttagtagagatggggtttcaccgtgttagccaggatggtctccatctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagttagtatcgagaacaagggaagaactggtttcactctgcacttctgatctttacaacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaaatt

SEQ ID NO: 331600 - DNA, 813 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacaaaaaaaaaacacaaaaacaacaaacaaaaccacacacacaaatccacaccacaacaccaacaaacaacaacagggggg

SEQ ID NO: 331601 - DNA, 1085 bp, Homo sapiens
gtgatcctcccacctcgacctcccaaagtgctgggattacaggctttgagccaccacacccggcctgagacttatcttactcctgccctgctactgaccctttgcctgtttttactctctctttaggtatgtaggaagctttagaaatttatacacctgctgtgaaataccaaaggttaagaacccccacaataaaatgtagatgagagattccccccccccacttccttcttattacagtcagcccatagagtgggccccatgaatcactaggcgtaggaacagaatggtttatgtggttggttgaactaatctgaaactcttcagttcctttatatgctgtcctaaaggtgagcactgagaggtgaggaagagagagtctgtacactggaggaagagaagttgtttcctcttttatgtaaaacattactgcagttcttctcggtgcaatttgcagagcaactctgagtctacataaataaaaagggaaagaggtggtttttccagcacatctgaggtctgatcccatctatcctttctttgtaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccaca

SEQ ID NO: 331602 - DNA, 409 bp, Homo sapiens
aaaattaaaatgaatttttaaaaaatactaagtctagtgatcctttgggcaagttactgaggtgactttgagaatcaggccttctaatctgaagtgtttttatttcacaggctgaagtttctctttggctcatcagccacccaggccttggacctagttgatcgacagtccatcaccttaatctcatcacccagtggaaggcgtgtttaccaggtagaagtctagagatgggggtgatccctacagaaaccccttaggacaaaatgttcttcatctctgtagaagctgttgactagctttaaatatttcctggactgttaaaaggcttttgccccaacttggtaaaattaacgaattgataattttttaaaatttttatttacttttaactgacagaaactgtctatat

SEQ ID NO: 331603 - DNA, 735 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccaca

SEQ ID NO: 331604 - DNA, 715 bp, Homo sapiens
gaagaagctccttgagcaaaatgccgccgccggtgcagaaaagcgcgcgaattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccaca

SEQ ID NO: 331605 - DNA, 975 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcacagtgtctcactctgtcactgaggctggagtacagtggcgcgatctcaactcactgcagcctctgcctcccaggttccagtgattctcctgcctcagcctcctgagtagctgggactacaggtggcacacaccgaggcaggtggatgatgaggtcaggagttccgcctgccttggcctcccaaggtgctgggattacaggcatgagccaccacacctggccttaaaaaaattcttaaaggctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccaca

SEQ ID NO: 331606 - DNA, 1932 bp, Homo sapiens
cgcgccccgacgtcactccgtctcgccctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgagattcctgatgaatatctgttatcgctgaagtttctctttggctcatcagccacccaggccttggacctagttgatcgacagtccatcaccttaatctcatcacccagtggaaggcgtgtttaccagagacagggtctcactatgttgcccaggctggtctcaaactcctaggttcaagcgatcctcccaccttggcctctcacaatattgggattacagtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaatggagtctcactttgtcgcccaggctggggtgcagtggcgtgatctcagctcactgcaagctccgctcccgggttcacgccattctcctggcctcagcctcccgagtagctgggactacaggtacccgccaccatgcccggctaaatttttgtattttttttttagtagagatggggtttcaccgtgttagccaggatggtctccatctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagttagtatcgagaacaagggaagaactggtttcactctgcacttctgatctttacaacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaaatt

SEQ ID NO: 331607 - DNA, 1230 bp, Homo sapiens
atccctaatcaccagaggtacaggctccttcccacttcttagcagcttttctcactctgaggcctcccatcttagagtaaagcccaggggacagagtggctgcactctaaaatccatcagcacattcatgcagaggccacccttcccacctgctgcttccagccaatgcctgagcatgggagggactcgtctgaggggcagcactggctccccaatggctttgctgaaactttctcagcaccacactccagtggaaaacgtcccccctcccccggcctttcctcctccacaggggtctgccaactctgccaacagcctccagctcccagccccattttcccttgcaggtgtttcccccagtaaatctcttgtacttttaatcctatcttggcatctgttttttggatgacccaaactaacacatagataattattctttttccttcaattccagtatctctgcctttataacatttcacattagtttcaccgaccatcacttaagggggaaaaaaaaaaagaaaatgcgaaattctgctttctaaatgagattacatatatataatacctggcaggtagtagacacataataaaaggcacacaaataaatagtctctgcgttagagaagacctaaggtcacctgacatagattaattcaaccaacatgtactaattacatgtgtgtggcaccttgctatgtgtggtagagatgcaaagatacatgacatggtctatacaccaaaacaagcttagaatttgacaaggaagaaaagacatacacacaaaaccaaattcatatgtagctgagttataaaatgctacgagagtcaggaaggggaagattcctttggctggggcaggaagacaggaaaggggtggaggaaagaagagatttggtctatctttgtctaagagtttacacttgaaccaggcaccaaaggccataggactgcaaccatatgagacagaggtgctgtccgtgcaagcccaaacagcgtgagccaatgcacagagataggcaggcgagctgtgtgtccaatggggctgaagcggggcaggcaggtgcctcctgccaggctgtcctgagccaggcccgtcagcctacggttcccgtgccacaggaggccactgacagcttgagaactgagttttcagggttagtaatcctgtggcaaaatgaagaatgaaccagaaggggagaccctgggggtggttctgacagaaagtta

SEQ ID NO: 331608 - DNA, 1626 bp, Homo sapiens
caaactggaaattttacttggcatctatcatgtaagccactgggatgtaaagaataaaagtagcttctatgcacaatgctcagtctagtggggaggcagacccaaaagacggaggtgtgcccagaggtgctttctgaccttgcagtggcacgaagaggctacatgccacagtgctccgggggatgggaataggtccagggtggtggcatgtcaccgtgctccagagatggcagcttcctcaggcagcaatggcttggctttaggctggtctgcactaaaggaggtttccctctagtgcagaaagaccattccaagctaagactgcaaatattcaaactgccgacgagaggaagaattctctttcccaggccctcgttttgcctaactggctaaagggcctgtgtgccacaagccacctttgaacttttagcttggttgattctatggtgtggcagtcatgaagatgtatttctccaaatgcaggggacagagtggctgcactctaaaatccatcagcacattcatgcagaggccacccttcccacctgctgcttccagccaatgcctgagcatgggagggactcgtctgaggggcagcactggctccccaatggctttgctgaaactttctcagcaccacactccagtggaaaacgtcccccctcccccggcctttcctcctccacaggggtctgccaactctgccaacagcctccagctcccagccccattttcccttgcaggtgtttcccccagtaaatctcttgtacttttaatcctatcttggcatctgttttttggatgacccaaactaacacatagataattattctttttccttcaattccagtatctctgcctttataacatttcacattagtttcaccgaccatcacttaagggggaaaaaaaaaaagaaaatgcgaaattctgctttctaaatgagattacatatatataatacctggcaggtagtagacacataataaaaggcacacaaataaatagtctctgcgttagagaagacctaaggtcacctgacatagattaattcaaccaacatgtactaattacatgtgtgtggcaccttgctatgtgtggtagagatgcaaagatacatgacatggtctatacaccaaaacaagcttagaatttgacaaggaagaaaagacatacacacaaaaccaaattcatatgtagctgagttataaaatgctacgagagtcaggaaggggaagattcctttggctggggcaggaagacaggaaaggggtggaggaaagaagagatttggtctatctttgtctaagagtttacacttgaaccaggcaccaaaggccataggactgcaaccatatgagacagaggtgctgtccgtgcaagcccaaacagcgtgagccaatgcacagagataggcaggcgagctgtgtgtccaatggggctgaagcggggcaggcaggtgcctcctgccaggctgtcctgagccaggcccgtcagcctacggttcccgtgccacaggaggccactgacagcttgagaactgagttttcagggttagtaatcctgtggcaaaatgaagaatgaaccagaaggggagaccctgggggtggttctgacagaaagtta

SEQ ID NO: 331609 - DNA, 411 bp, Homo sapiens
caccgcaggaggtggcaggggtccagtcgacctgccatgagacctggaggtaggtacagagcctcacctgcaaaaaccccatgaggtaggaagaaagaatgcctgctctctcttaaggccttcaagagggctgaattagactagcacttagcacagagcctggcatagagtgggggctcaattggctcctgttaagtgactgagtaaaccaaccagtgagcaagccaactttctcctgtgtcctccccaacacgatggggactaaggaaaagaagctgggagctgggaagccctgtcattgcaacaggaagtagtaacggcatttagcaaaggtggaggggaaaataaaggaagatgctcctctctcccacacatcggaaaaatgaactaatcagcagcaagcagttaatg

SEQ ID NO: 331610 - DNA, 129 bp, Homo sapiens
gggtcattttggatttttttttaatgataaggtattccttctttgatcacttatgcatttttggatatttcagttttaaaaaagatatgttttggctaggcgcagcggcttatgcctgtaatcccagca

SEQ ID NO: 331611 - DNA, 582 bp, Homo sapiens
ttgtgagagttaaatgtgatcgatgatgtaaattgcttcatagaatgcagaatgtgtaatagctcacaataagtaggtattatgtttacatattatgtttgtatttatgctacttaaatacaaaactggacaggccaggcatggtggctcatgcctgtaatcccagcactttgggaggctgaggtaggtggaaaacctgaggtcaggagttcaagaacagcctgaccaacatggtgaaactccatctctactaaaaatacaaaaattaaccaggcttgatggtgtgcacctgtaatctcagctactcgggaggctgaggcaagagaatcgcttgaacccaggaggcagaggttgcagtgcaccaagactgcgccattgcactccagcccgggcaacaagagcgaaaccccatctcgaaaaaaaacaaaacaaaactagacaagtgagtgcctacgtgacactcaaatgttgccagcatacagttaagggccctagtcaatgtaggcctgcttcttatagctttttgactatattatgctgtctttgacttagtcagtcaacacttattgagcacctactaag

SEQ ID NO: 331612 - DNA, 351 bp, Homo sapiens
gtgtcctaaaatctgcctcatgggtagcttgccttggtgaggacagatgccccaggaacccaggccggagttcctggagaccctctgctaatctcatgattattgaactttcaagctaccacacactcctattcactgtcaccattcattttcacagtaaccctgtgggatctagctacagtgacaatcctcattttacggatgacaaaacaggtgctcgtagaggttcactaatttgctgaaggcttcacagtagttagtaagtagctggggtttgagcccatggcagactgactccagagttcatgccgtacacatcatctggctttgcattctcccagaccacagaat

SEQ ID NO: 331613 - DNA, 275 bp, Homo sapiens
atacagagccggttgaccttaggattgctagaatctgtgtttggtgctatgcgttttttaccctttgatgtgagacacttgatgcgaacttgcttgtccactagtgcatatctgacatggaatttaaattggcaagaaatgtgtgcagaccaggctaaacagaaccatgttgctggacacggagacattacagaggatatgctattaggtaatggcccttattcagacctggaaagtcaaatggcactcccagacgctgcttatcagcagtgtgc

SEQ ID NO: 331614 - DNA, 544 bp, Homo sapiens
gggaggagggagaaggattcaatgcactgttgctggctctggatgcagggaactaacatgcaaggatgggagagagacctctggaactaatggcagtcctcatcagacagccatcaagaaaacaggacctcagtcctacagccgcatgaaccaaactatgccaacaatcaaaaggaggctggaagtagatgcttagagacttcagaaaggaatgtagccctgccaacaccttcatttccaccttgtgatattctaagcagaatatcagctcactgtacctggacttctgacttactcaatttgagataataaatttgtgctattttaagccacttaagtttgtggtaatttcttacagcagcaataaaaaatacacggctaattcaggcaacagcacaacccactttggaacctggtagtctacagtggctatcctcaagatctgtgtagcccagtctgtgaaatgcggacatctaataggcacctgcagcaatcaccaggttagtatgactggaagatctaatactttcagttattaatattt

SEQ ID NO: 331615 - DNA, 666 bp, Homo sapiens
aggaggcacaggacggggtgggagtgagggtgggtgcagccacagctggaagtgtgcacagctggaacttcccagcattgagcaggtcctcatgggaacaatttatgaaaactatgattatttttccatttcctagactctgtgattgttttcacaagaagctaagtggtttctgtgtgattatatatcccaggtgttgtgtggaattttaactcaaataccaaaatctagggcgatttgcctatcacgcatccatttattccacttcctccagcaagttcacagcactatgtaaaatgcttagaaccagtggaggtttttgtgagttctggaaaacaagaggagggaaaaatcaatggagaaaagcaggagtgaagcagatagccactgagaagaagaagatggcaggctgacgggaaagtacagcggccgagtgtctgctggcgagctgtgcgtcagggcccacttgcacaaatagtaaggcagaactagtggccccctagacccagggggcgtttagaggtcctgggaaacataaactctccatcctaagacaacactacaccctcccactcctaatcaaggcccttacattccaccattcaagcgcattaaataatagttgtccaaatgtgtggtaaaggattttctcttttcagagccact

SEQ ID NO: 331616 - DNA, 123 bp, Homo sapiens
tctagagtctagaccaacaggcctccacactcacgtcccagagatttccctggtcccacctactcccagtggcaaccagacttctgcacataggagagatgtcatactcagagtccagcctcc

SEQ ID NO: 331617 - DNA, 278 bp, Homo sapiens
gggattacaggtgtgagccaccatgcccggcccaactcagccctattgcaaaataatcactccttggggttcttctagctaaaagctatagatattttttaatgaattgatttaaatcaaattagtccttaaagtgtccttgtggagcctgacagaggaatgagaggcatcaagagttgtattgtattgcctgccaaccctagaccccttttctttgagaaacgagacagcaattctaggtcttagtgcataaggccagtctttgtgctttgaggtgc

SEQ ID NO: 331618 - DNA, 468 bp, Homo sapiens
gggtagatctagaggatcccgagctctctcgtggggacgacctgcctacggaaaggagctacccactgcaggtctcctgagggctgttctgtcactcagtgaagctcctctccgccttgagcaccttccagttgaccgtgaacctcattcttcctggacgcaggataataacatgggacccactgaaaggcgggactgaaagatctgtaaaacagggctgaaacatgcccccttgctcaccacgttgcagacaatgagaaggaaagaagagctgaggccctttggggagcccagacctaagagctccccaaaccagggttgtgacaccctctttggggctctgggattcttgatgtctccaagcttcagggtgccactacgttccccagtacccacagtggaagccactgtggtatgtctgatccagatgcaacctcacagggagccagtgcctggatatgcccgccc

SEQ ID NO: 331619 - DNA, 802 bp, Homo sapiens
cagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggagtcatagtgagggttcagcttttgcctttcaggccaactggctgagtgattcgaagaaagtgaggaatcctccctggacactgtatcgcccttcgtcgtctttcagtcaatctcttccactctaaggattgagtgagcgcgagctggggactctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331620 - DNA, 348 bp, Homo sapiens
actggctgtccacctggcactggtcccgacagaggccgagctggggaaagttaatgttcacctgggggcaggaaccctccttatcattgggcagagagcagaaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331621 - DNA, 702 bp, Homo sapiens
aactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcaggtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctacccagatataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331622 - DNA, 733 bp, Homo sapiens
taaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcaagaaaaaaaaaaaaaaacctcggggaatagtttctctccccatccccccggaggggcgccccgggttgcccggggctccgccggagttagggcgcgggtaaagtagcgcgggtgtccccccaaggcgcaaggatattac

SEQ ID NO: 331623 - DNA, 495 bp, Homo sapiens
cagttctggttcagcctggagctcggggcacacgccagtcttctctgctcctgtgcctgagactagtggtgaatgccgaacagcagcaggctgtaggaggagggcggcggctagcgggcctaggcgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331624 - DNA, 938 bp, Homo sapiens
cagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggagtcatagtgagggttcagcttttgcctttcaggccaactggctgagtgattcgaagaaagtgaggaatcctccctggacactgtatcgcccttcgtcgtctttcagtcaatctcttccactctaaggattgagtgagcgcgagctggggactctgcccaatggtgcttgctggagctgcagtctccaccaggctatcagaacagggggtggcttaaacagcatggaatctcagctttccgttctccagaggaaaatgctgaggattagaggcagggataggacctggagagaaccaagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331625 - DNA, 214 bp, Homo sapiens
taggtcggaccagtgtctgagaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331626 - DNA, 253 bp, Homo sapiens
aggagctggtctaggatttaagctgcaggtactcctgcctagtctaatggatattgttgttgatggtattgttataattttcttcctccagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331627 - DNA, 594 bp, Homo sapiens
taaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 331628 - DNA, 801 bp, Homo sapiens
taaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcagtagataggaaatggctcagttattcaatatcaatttgagcaaatgttgtatactatgaaaaacaattacaaagatcatgtagaacaagtgaaatatgaaaactgaaaggtatcagaaatgagaaaatatgaaatatatactgtttacagctatatgaaatatgtacatatatatatggagcgagagcgcgagacaaaagagaaatg

SEQ ID NO: 331629 - DNA, 453 bp, Homo sapiens
gtgcctcctttttctttcaaagtcaacaaagttcagcagtgatttgggaacattagaaaatttttttttgctattctaactaacgtttttaatatactacataagatagctagtaagtccatagacaagtaaaaataattcaggaaatcactattttatgatgggctgacactttaaaactcataaaatataagttttgaattctttaaattgagatggccacttaagaatttaatcacaaatatgccagtgaaaagcaaatgattcattcaaggatttttgagcaattagaactcacagctttcttgtctaagactttcacttaaatcacgtgagtataagactgagttccatgtagaattatattcttcggcaaccaaaccagaaaaggaaacttgcccagagccagcagttagctgagaaaaacttcaactgaaagaaacatttaggcca

SEQ ID NO: 331630 - DNA, 1341 bp, Homo sapiens
gattcctgctgactccagggggacacctggcacctcagcttcctttcccacttctccaggctgcatggaggggtgccgggcagggtcctcctggaagggaacctcctgcagcctcaagcaccaggtcatgacatgacatctatccctttcccaggtgaccgactcctgcaggtggatggagtgattctgtgcggcctcacccacaagcaggctgtgcagtgcctgaagggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcggtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagatggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagacctttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagataaacacagagaacagccgtcttccgaggcagagactgagggtttctgcatggaggtcctttggacagaagagccctcaggtgaccttggtccaaagagtgtacccaccagctctgccactgggaaagaaacctgtaggctcctgcaaaggtgacctgggatgaagggcctggcccagttgttaagagctcacttcaagaagagcatgcttgtcaattccaagactcattttgaatcatggctgttgcctctcttcagttctggggtttacgtccagcaaagctttgtgcgcg

SEQ ID NO: 331631 - DNA, 412 bp, Homo sapiens
ccataaagtggcatgagtcctacttttccttcacaaaatatttctcttttatgaggctaaggaaaactcccttgctcagtgggattaagaagaggacggaactgttctgtttagggaaggctactggcaaaatgacgaggtcacccattaaaagctgcttattgttttagataaacacagagaacagccgtcttccgaggcagagactgagggtttctgcatggaggtcctttggacagaagagccctcaggtgaccttggtccaaagagtgtacccaccagctctgccactgggaaagaaacctgtaggctcctgcaaaggtgacctgggatgaagggcctggcccagttgttaagagctcacttcaagaagagcatgcttgtcaattccaagactcattttgaatcatgg

SEQ ID NO: 331632 - DNA, 827 bp, Homo sapiens
gactttgtatcctgaattgcctcgtctgatatggaaccaataatttatcagctgtcaaattccagatgatactcaccctaactgcccaagatggacaactaatcaaaacaagctcaggcctcctattgttacagagaaggggtcccgacgcagaccccaagggaaggttcttggatctcatgcaagaaagaattcagagcgagtctataaagtgaaaacaagtgtatttaaaaagtaaaggagtaaaaaatggctactccatagagacagcagccccaagggctgctggttgtccatttttaaggttatttcttgattatatgctaaaaactataattagatattattgcattgtgaattatttatgcctcccgataagagaagctggctgccttcagcaaaatcctttcctgaagcttttgtaaaacctcctggccttccaagaaggtttgcatctttctacgatttttctcaccatcctgaccgatctcctacactttatgacctgtatcttgtgccaacctcctatctcatcctgtgacctagaatgccttaatgtctgggaatgcagccccgtaggtctcagcctcattttacccagcccctactcaagatggaattggtctgatttaaacacctctggcactaacatctcctttagacagagcagggcgagagttctgtggtcacaataggtagggactatgccccaatcagcatgaagcagttacagaaggaaagaccatcagtccctctgcctcccataaagatttcccaccctgtagaatgctttcatgtttgaataaatccctgctttcactgcttca

SEQ ID NO: 331633 - DNA, 4316 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctgggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331634 - DNA, 4875 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaagataagcagatggaggctcagagaagtgaggagccagcccagggccaggtaggagtgggaagatggacagaccccaggctccaaactctaaaccttcccagtgggagccatggcctccttcttagggagctggaaggggctgactcctttcctggcctccccgataaatcccggggtgttactaaactcaccatgggtcacctgaccctctacccaaagctcattttagaggaaatactgtatgattttgtttttccttcccaaatgtacttggtgaaaaacacgcagtagagactcgaacatatttgctaagcaaaggggagtgacaggagccgcaacggccaatcagctttaggcagggaagggaagcacagttccaacaggccaccgggacaagcatgcacagcagctgttacctgtgagcagcgtcttccttaggaccggcatcctgccacttctcttcctgaagacactgagtgaaaaaaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331635 - DNA, 1982 bp, Homo sapiens
agctcggtggcatgtcctctgcagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331636 - DNA, 4439 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccagaaaaaaaaaaaaaaaaaaaccgggtcatactggggcgagaaaaggtatag

SEQ ID NO: 331637 - DNA, 1731 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaacttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331638 - DNA, 627 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtgggtaaggctgccgccctgcctgtcccagctcagcccccatggcctgtgctctggagctagcctggtcctgaagtcttcagctctttct

SEQ ID NO: 331639 - DNA, 592 bp, Homo sapiens
ccttgtagctgagagtacaggcacccaccaccatgcctggctaattttctgtagagacaaggtctcctatgttgcccaggctggtcttgaactcctggcctcaagggatccgtctgcctcggcctcccaaagtgctggaattacaggcgtgagctaccgtgctgcctctgtgcacttgacatgagatcttcaccagagcaaaccaagtcacccaaataagctggctcccactggggaacaggagccccagctgagccgcaggagccacatggcacaccctgggcgggacatcgggggcctgggttcaaatcccggcactgctgagtctcctcactgcgtggcctgggcacgtccctgctcctcgccgatgtctgggtccccatctggacagtggtgtccatgatgaaaagggcatcgtgtaggccctgtcactgttttagcttgtgaaagtttcctctgtcctttgaggggcatgattgggacagtggagtctgtgacgtggggggcttctctctgctcttgcctcctccatgcttacctctgacgcctgtcctcccaggtctgtagagttccgtgacttcctgaagatagc

SEQ ID NO: 331640 - DNA, 373 bp, Homo sapiens
cagctggggagcgcaggggctggtgcgagacctggaatggtgaccaggccccctctctgcctttgcccaatccctgcccctcaaataccccgttctgaatacctaaatctggcctcatccttcatggccccattatcccctcctccatgcagccttcctcgattgccctgcctccatctggaagtaagctcttccatctctggataccccaacactttacattgaccacctcccaaacccttagcacctcctaccttgttttagggttatttatttgtaagtcacatctccttgaccaacccagtatattcccctgcccacttggcatcttttaagtctgaaggacatcaaacttgtgatgtcccagacctgg

SEQ ID NO: 331641 - DNA, 296 bp, Homo sapiens
ggcgctggcccacttcatcttgagggtgtctgactttctccactgcatctctgactcttgccttgaacatacagcagcatggcctttaatatatatatatatatttttctagaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtgg

SEQ ID NO: 331642 - DNA, 411 bp, Homo sapiens
ccttagctgaaatgctgagacttgtctaatggttttccctggccaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcaagcctgggaagggccaccaatggtggtaacagggtggggctatggtaagaggagtgggcattggtcctttggtgagagggctgtctgtctacagcatgaagtgggggaatcaaggaggcaaaaggaaactcattttgcctgcgatcctgcactcccccatctacccaaccgttcacctatctatccactcatccattcatttattcacccatctatccacctactcaccta

SEQ ID NO: 331643 - DNA, 4389 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331644 - DNA, 389 bp, Homo sapiens
gcctcagcacagtttctgaaggctgagatcagggaagagcaagggaataagctcagaacccccagctcctaggttaagttgaggcaagagggacgatggatggccacatctctctgggggtggttctgaagctgtgggcccagcagagctgtggcctcacctgctgcgacagccatgggtccttagctgaaatgctgagacttgtctaatggttttccctggccaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagtctccgtcgaact

SEQ ID NO: 331645 - DNA, 3528 bp, Homo sapiens
aaaagcatttaggggcttccttgcattttaagtggttcattagggggttttgggtttgactcatagtttaatctccaaaatatctgggttcaatatgggatttaggaatgtaaagcagttggtttgggtttaaatttcaaagcttggtaaaaggccctggtaaaatttgggagagagaactcttaggccttagctacaaatgaagttctgtcatccagaggtcagccacgagacccagctgataactggtaaatccaactaaaggaaacagctcaaagccatcttccccgcctccggggcctttctggaggtgggcagtgttgcgaatgacgatagccaccgcactagaggcctgggcttgaggcgaaccctgtacaaagtgctttaaaaagaacagacaggctccttcatcctctcactttacagataagcagatggaggctcagagaagtgaggagccagcccagggccaggtaggagtgggaagatggacagaccccaggctccaaactctaaaccttcccagtgggagccatggcctccttcttagggagctggaaggggctgactcctttcctggcctccccgataaatcccggggtgttactaaactcaccatgggtcacctgaccctctacccaaagctcattttagaggaaatactgtatgattttgtttttccttcccaaatgtacttggtgaaaaacacgcagtagagactcgaacatatttgctaagcaaaggggagtgacaggagccgcaacggccaatcagctttaggcagggaagggaagcacagttccaacaggccaccgggacaagcatgcacagcagctgttacctgtgagcagcgtcttccttaggaccggcatcctgccacttctcttcctgaagacactgagtgaaaaaaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331646 - DNA, 3783 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctccttctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccag

SEQ ID NO: 331647 - DNA, 1174 bp, Homo sapiens
agcgggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggaggtgagtggattcccctcccactctgctccctgaagggtggagcctaatgaactcaccagtgacctggacgctgggcatgttctca

SEQ ID NO: 331648 - DNA, 376 bp, Homo sapiens
gcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggtgagggcgctgaggtgggtggccggacgcgcgtcgaggggctccggaaggaagggatgcctgagccggacccggccagcctggctccggctccgagggctgcccggcgctgaattcggggtccctggccctcatcccgatgactcttgttttttggggggaacatcactcg

SEQ ID NO: 331649 - DNA, 390 bp, Homo sapiens
ttctggcattttcttttgtttacagggtactggcctaattgccatgagtctcattttttttcttctcagcaatgccactggctctctaaaaaacagaggataatgtgatagagacagataaagaatttttctaaattaggcaatcaaaccaagaaaaaacacataaaacatgcataactaagtcagtgtttcctcaaaaggggcagagtttggtaaagaaaagccttgtcttgtacactgctgtgtatgcactttatagaaaagtactagcatagagtgggtgctcagtaagtgttagttaaatggatgttgaagggttgggaaagagaggagttgagttgagcacagagatgtgatacaagtcctacacagtcatgagtttataagtgt

SEQ ID NO: 331650 - DNA, 420 bp, Homo sapiens
attcagactgtagcaaccccttctcttttctctctctactcttttcctaggtgattgtagccactcccatccttacaccgatgactcacaaacatacatttagctagccctatcctctggcttcagacctgcatgtccaatcagatgactaatgtcatcttttgggtttatcagagacatctcaaactcagcatgtcgaaaatggaaatcttgccctttcccagagtcttttgatcctcttcctctgttgccgcctcattgaatgacaccaccatttatgcatgccagaaacctgagagtcaattttgacactccctgtcacctgccatattcaattcattaccaagtcttgtcagcaaccacccctcaaatccattcattctcctttatcatcgccttagtgcctactctcctgcagta

SEQ ID NO: 331651 - DNA, 172 bp, Homo sapiens
cgcctactatgggccaggaagtattttaggtactgcgatagaagagtaaaaagcaaagtccctgtactcacatatcttactttctactggagagaaatggaccaaaaccaaaacaaataaaaaacacacaaataagtatagggaacatcaggggtaagaattcctgtgaagg

SEQ ID NO: 331652 - DNA, 321 bp, Homo sapiens
ctagagtcaggtaacttcctctttccagctccatctcaggtacctctccctcatcgtagcttgtctttatgaatgtcagctttttgtttgttgtagaccaaactaatgcattcatttaattctaacatctaatctaaggtatcttgggttatctccatttacacttataaactgaggctttgagaagattaggtgactagtccaaggctggtattctggatcctttgggcactggaggacaactaacacagccggcgttcaccactgccaaaaagtaacgaacgctgccgtagtgtaaagacctcccaagggtatctcccc

SEQ ID NO: 331653 - DNA, 423 bp, Homo sapiens
cctggctgacagagcaaggcgcacacacaaaaaaaggtcaagttgtgtttcggcaaatttgaaagaactatccaggcttttcttaatagaaattcatggcatcaacaactggttggagaaaaaaataggtaatctcttttgctaaacaaatatctccactgaaggtcatgtttgttggtaccaaaatgaggaaaaggattagagatcaggaagcagggttttgacactttgcacaagtcctgcaccactctcctatggctctccactgcatttctctccaaccctcctaacgcccaggttcaatgcctggattactgccacttcctcacagctggtttcccttgagtcttatcccccataaatccctcctctatacagcattcagagttaaacctataatggttccccaatgccgtatggcaa

SEQ ID NO: 331654 - DNA, 2245 bp, Homo sapiens
  misc_feature (1975)..(1975): n is a, c, g, or t
  misc_feature (2160)..(2160): n is a, c, g, or t
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccaggattttgagaggtgacagcatgctggcagtcctcagagccctcgcttgttctcggcacctcccctgcctgggctcccactttggtggcatttgaggagcccttcagcccccccactgcactgtgggagcccctttctgggctggccaaggctggagcccactccctcagcttgcagggaggtgtggagggagaggcaccagcgggaaccgggactgcgtgcagcgcttgcgggccagctggagttccgggtgggcgtgggcttggtgggccccgcactcggagcagccagccagccctgctggccccgggcaatgggggacttagcacccgggccagtggctgcggagggtgtactgagtcccccagcagtgccggcccactggcgctgtgctcgatttctcgccgggccttagctgccttcccgcggggcagggctggggacctgcagcccgccatgcctgagcctcccacccactccatgggctcctgtgcggcccgaacctccccgaccagcaccactccctactccacggcgcccagtcccatcgaccacccaagggctgaggaatgcgagcgcacggcgcaggactggcaggcagctccacctgcagccccagtgcgggatccactaggtgaagccagctgggctcctgagtctggtggggacgtggagagtctttatatctagctcagggattgtaaatacaccactcagcaccctgtgtttagctcaaggtttgtgagtgcaccagtcgacgctctgtatctagctgctctggtgaggacgtggagaacctttatgtctagctcagggattgcaaatacaccaatcggcactctgtatctagctcaaggattgtaaacacaccaatcagcaccctgtgtttagctcaaggtttgtgagtgcaccaatcgacactgtgtatctagctgctctggtggggacttggagaacctgtgtgtcaaaactctgtatcttaactaatctgatgtggacgtggagaacctttgtatctagctcagggattgtaaacgcaccaatcagcgccctgacaaaacaggccactcggctctaccaatcagcaggatgtgggtggggccagataagagaataaaagcaggctgcccgagccagtattggcaacccgctcgggtccccttccacaccgtgggagctttgttctttcgctctttgcaataactcttgctactgctcactctttgggtccacgctgcttttatgagctgtaacactcactgcgaagatgtgcagcttcactcctgaagccagcgagaccacgagcccaccgggatggaacgaacaactccagacgtgctgccttaagagctgtaacactcaccgcgaaggtctgcagcttcactcctgagccagngagaccacgaacccaccagaaggaagaaattccaaacacatctgaacatcagaagggacagactccagacgcgccaccttaagagctgtaagactcaccgcgagggtctgcggcttcattcttgaagtcagtgagaccaagaacccaccaattccgaacacaatttatccttcaacagtttgtcnctgatgtgtctatgtgtatatctctgtatttgtcctgtattgagttagttgaatggctttgttctgtaaattaacagttttcatc

SEQ ID NO: 331655 - DNA, 1118 bp, Homo sapiens
  misc_feature (1107)..(1109): n is a, c, g, or t
gatgaagggttctgcagtcaaatgaaattcagagctgttttataattgccaagggtaaaattagcagagtcaattattttccctttggcttttccctgaagatattaggggtcttcaaggtaattgccttaggtaacacttagatttttaaatatcttcaagtatagaaattgtttattaatcctctggtaattgtcttcttaccattatagctgtagtcacataaatgcaaattaacaagattttgaattcaagagggaatttaaaaattaatgcttgggttttcattcattttcaattatggaacataagggcaagtttttattttagtacttcactgtacaaagacctggactaaaagacctcagaatgcctctttttaaatcataaatttcctgattccattgggataagttgctctatattgtgtccatgtagaacatcactggatgctgtagtgatgtggtcatgccagaatctaaaattttagtgtttgagcagcaagctatcagtgagacatgctaactaattggaagggaaatcatgaagtggagaagtactataatttcgaaatctagctggccattaacaggcttcctctggtctttgtatttatttagactgggtttgtatttaggattaagccacagtgcaaataagactgtgtggattactacctgtcatcttgtttttgaaaagtcttttactttacatatataatgataagcctagtatttaaagaatggaatttatcacgttatttttttttctttgtagtcattttcatttaatggacctattgctatatatcagatgggagactgtgagtcagcctggatcttgtctaaacacccaagagcattgtcatgatgtcactcctggaggttgttctattaagcattagtgatttatacttccggataaccagtggcacagatgtactctttacatagctgatgtatttccttatgttaactttgttttcctaaaggcgtaaatatgttgtttaaaatgaagtattttgtttgtacaaatatgctcaatttatgcatataaatctccctttacaccatctatatagtttaataaagatgctattgtctaaannngtttgtctt

SEQ ID NO: 331656 - DNA, 338 bp, Homo sapiens
catatttggacaatatcaaagctcaagaaaaaggaagattggactatgctaagtcttcaagtacagaagttcaactttctaactttcaacaaatgctactttcaacactcttaagcaccgcatgataagcactgaacgatgagaatattgagagagcatgaagaggagatggttagaagagaggcaacattgacagtgaggaaatgacagatgtgctcagtgttgagctgtttgacctcaggaacaattctctaggactcccagtttgtgcttctgtgagtggaagaaaacacactcaaaagtgtttgatacagtctctcaaaaatagtcaacacagg

SEQ ID NO: 331657 - DNA, 3659 bp, Homo sapiens
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagagatagggtctcgctctgtcgctcaggctggagtgcagtgtcacaatcatagcttactgcagcctcccactcctgggctcaagtgatcctcttgcctcagactcccagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctttccag

SEQ ID NO: 331658 - DNA, 3562 bp, Homo sapiens
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagagatagggtctcgctctgtcgctcaggctggagtgcagtgtcacaatcatagcttactgcagcctcccactcctgggctcaagtgatcctcttgcctcagactcccagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctttccag

SEQ ID NO: 331659 - DNA, 3021 bp, Homo sapiens
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctttccag

SEQ ID NO: 331660 - DNA, 2414 bp, Homo sapiens
tcttttctttaataaaaggctggacatcagaatttatcttatgactcatggccatgtgcttcccatactgaaatgccatattctgaacctcagctcctgtagtcttacatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctttccag

SEQ ID NO: 331661 - DNA, 1577 bp, Homo sapiens
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagagtcttcaagtacagaagttcaactttctaactttcaacaaatgctactttcaacactcttaagcaccgcatgataagcactgaacgatgagaatattgagagagcatgaagaggagatggttagaagagaggcaacattgacagtgaggaaatgacagatgtgctcagtgttgagctgtttgacctcaggaacaattctctaggactcccagtttgtgcttctgtgagtggaagaaaacacactcaaaagtgtttgatacagtctctcaaaaatagtcaacacagg

SEQ ID NO: 331662 - DNA, 191 bp, Homo sapiens
tcagctcctgtagtcttacatcaggaatttcttggaagagatttgtggattaaacagatcggagaggtaaaatgaaattactcctgttttaggtaccagtagtaattagtggattttagaacataattgatatttcttggtgatatatggctatagatgagccttaggcatattcacgtaacaggtaaaat

SEQ ID NO: 331663 - DNA, 3551 bp, Homo sapiens
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctttccag

SEQ ID NO: 331664 - DNA, 766 bp, Homo sapiens
agcggggtgtctcttctagcggcggaggacgtcagtggctgtcacggggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataaggctcaagaaaaaggaagattggactatgctaagtagaaacaggtttcaccatgttggccaggctggtcttgaactcctgacgtcatgatccacccaccttggcctcccaaagtgctgggattcctggcgtgaaccacca

SEQ ID NO: 331665 - DNA, 3281 bp, Homo sapiens
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagagatagggtctcgctctgtcgctcaggctggagtgcagtgtcacaatcatagcttactgcagcctcccactcctgggctcaagtgatcctcttgcctcagactcccagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctttccag

SEQ ID NO: 331666 - DNA, 1255 bp, Homo sapiens
  misc_feature (1244)..(1246): n is a, c, g, or t
attccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaagtcattttcatttaatggacctattgctatatatcagatgggagactgtgagtcagcctggatcttgtctaaacacccaagagcattgtcatgatgtcactcctggaggttgttctattaagcattagtgatttatacttccggataaccagtggcacagatgtactctttacatagctgatgtatttccttatgttaactttgttttcctaaaggcgtaaatatgttgtttaaaatgaagtattttgtttgtacaaatatgctcaatttatgcatataaatctccctttacaccatctatatagtttaataaagatgctattgtctaaannngtttgtctt

SEQ ID NO: 331667 - DNA, 202 bp, Homo sapiens
taaccatgcagtgtcaagaaatgatttggatttgggtaaaagtaagcctaagtacaccaggggttcaatgccagtttttactttgatttcattttcatatttattgctaaaagctcttcctcacatatctccgggcatctgaacctcacagtccatcccactgcctggctgtctcatagttgggatatgtagaatgtcacaa

SEQ ID NO: 331668 - DNA, 133 bp, Homo sapiens
ctcctaaagtgttgggattacaggcgtgagccaccacgcctggtctaaatttttttttagagacaaagcctcattctgttgcccaggcttgagtgtagtggtgcaatcatggtgtactgtagcctcgacctcc

SEQ ID NO: 331669 - DNA, 1313 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331670 - DNA, 1446 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatctgtgagtatgaagtggtgagatgagtgggcagtgctctttggtgctgcagcttccttccagtctagatgtgaagtttatgagtaagttttacaggcaagccctgcctagactaaagtgtctctttggtccccagtctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331671 - DNA, 1255 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaagccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331672 - DNA, 1540 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggtgagaaaatgaaattttgggagaagtggactatctgggttcaaatcctggttgactgtgatgttgggtaagttacttatctttgtacatcagtgtctttcatctgtgagaacacttgccttgtctcccaagtttgccataattaaatgggaaacacgtaaagcattcagcatagtgctggcactcagacgtttactagttcttaggagctccctccatttgtgcaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331673 - DNA, 1273 bp, Homo sapiens
aaaacactgggcgagatagaatatttaataagagacatttgggcaaagggaggtttttggatgagaggataatacttgagggaattatctaagggggaggtatgaagagatattacacagagagcagatttcacttaaatgttttttcctgtccctctagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331674 - DNA, 1080 bp, Homo sapiens
ggaggttggggttacggggataggtagggggtctgttgggtttttgcagataagtggttatttttccttgggcaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331675 - DNA, 1163 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331676 - DNA, 402 bp, Homo sapiens
aaaacactgggcgagatagaatatttaataagagacatttgggcaaagggaggtttttggatgagaggataatacttgagggaattatctaagggggaggtatgaagagatattacacagagagcagatttcacttaaatgttttttcctgtccctctagaatttccgtgtggatgtagtacacatggatgaaaactcactggagtttgacatggtgggaattgacgcagccattgccaatgcttttcgacgaattctgctagctgaggtattggcaggcatggtgacaaggctggagttgctttgggaactgcactgacacctcacttggagaattaagtgtctcaagctgtccttccctccttaattttcctggaattttgctgagcattttaccttctc

SEQ ID NO: 331677 - DNA, 348 bp, Homo sapiens
aatatcctgtgttaacagtgaaaaaatcttaaagttcttttcctaaaatcctaaatggcactgatattgaattccattatactcttagtttagctgcatttccgtcaggctgcacattatggtcactggcccaaaaagtaggaataaaaaaataggaaggaggacatccttgtaacaaactctccttcaccattctccttataatttcaggtaagaaagatttgctggctgcggtggctcacacctgtaatcccagcactttgggaggccaaggcgagtggatcacggggtcaagagagcgagaccatcctggctaacatggtgaaaccccgtctctactaaaaaaaa

SEQ ID NO: 331678 - DNA, 1128 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatctgtaagaaagatttgctggctgcggtggctcacacctgtaatcccagcactttgggaggccaaggcgagtggatcacggggtcaagagagcgagaccatcctggctaacatggtgaaaccccgtctctactaaaaaaaaaaaaaaaaa

SEQ ID NO: 331679 - DNA, 1202 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331680 - DNA, 1603 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtatggtatttgggatgctgttcaagttaggacctaaattatattttctttcaaggtgacagaaataaaaaccctgggctcctaaaagtataacctggtttgctaccaagtggcaaattagaaaaaggaataaaaaaacatggtttgttctcattaggtaaaaaggtggccagagttgccaacccccggctggataccttcagcagagaaatcttccggaatgagaagctaaagaaggttgtgaggcttgcccgggttcgagatcattatatctgtgagtatgaagtggtgagatgagtgggcagtgctctttggtgctgcagcttccttccagtctagatgtgaagtttatgagtaagttttacaggcaagccctgcctagactaaagtgtctctttggtccccagtctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331681 - DNA, 1628 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggtgagaaaatgaaattttgggagaagtggactatctgggttcaaatcctggttgactgtgatgttgggtaagttacttatctttgtacatcagtgtctttcatctgtgagaacacttgccttgtctcccaagtttgccataattaaatgggaaacacgtaaagcattcagcatagtgctggcactcagacgtttactagttcttaggagctccctccatttgtgcaggagatgaagaaggcacagagatagatactctacagtttcgtctccaggtcagatgcactcggaacccccatgctgctaaagattcctctgaccccaacgaactgtacgtgaaccacaaaggtgagtagtggtagggtgaggaagaggccccactgtgggtagctgctaggtttagggactgagatcttctgacatgtttttcctccagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaa

SEQ ID NO: 331682 - DNA, 442 bp, Homo sapiens
gcagggctactaggacgcacgcgcgagatagaacctcgagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtattggcaggcatggtgacaaggctggagttgctttgggaactgcactgacacctcacttggagaattaagtgtctcaagctgtccttccctccttaattttcctggaattttgctgagcattttaccttctc

SEQ ID NO: 331683 - DNA, 453 bp, Homo sapiens
ttccggtagtgagaacccttccggtgggctaggtactgagcgcgcgagtacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacat

SEQ ID NO: 331684 - DNA, 893 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacat

SEQ ID NO: 331685 - DNA, 538 bp, Homo sapiens
ttccggtagtgagaacccttccggtgggctaggtactgagcgcgcgagtacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccaaaaaaaaaaaaaaaaaaaaaaaaaaaaaaaggggggggggccgggccc

SEQ ID NO: 331686 - DNA, 838 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacaggtaactgttaagggaccagaatcatgcctagactctctgggaagtgcggtggttattctctcccttcccctttcgttgattgttctcaaaacagtgccagcccaggtgttcacagtctcttaaaacgtctcagcccctcagtttattatcttaaaaatgaagttctgggccgggcgcggtggctcacgcctgtaatcccagcactttgggaggccgaggcgggtggatcacatgcggtc

SEQ ID NO: 331687 - DNA, 1532 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggatcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 331688 - DNA, 1947 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtccaggagaagtaaggaattttttttttcttttttttaagaggaagtctcgctcttgttgcccaggctggagggcagtgggacaatctcagctcactgcaagctccgccgcctgggttcacgccattctcctgcctcagcctccccagcagctgggactacaggcacacgccgccacgcccggctaatttttgtgtttttagtagagatggggtttatctgtgttggccaggatagtctcgatctcctggtctcgtgatccccctgccttggcctcccaaagtgttgggattacaggcgtgagccactgcgcccggccggaaaatttttttaatgtagtgaaatatgtctaccatttcctacccaatttttttgaatccccaagcaaaatcttactgagaaagcatctattactttttattaaactgttccatgttaggtagagaggagaagatgcatgtatgtatttggaataaattctgcttctgaaaacacctatc

SEQ ID NO: 331689 - DNA, 1896 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggatcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtccaggagaagtaaggaattttttttttcttttttttaagaggaagtctcgctcttgtcccccagactggagtgcaatggtgcagtctaggctcactgcaacctcggcctcctgggttcgggtgattctcctgcctcagcctcccaaagtgttgggattacaggcgtgagccactgcgcccggccggaaaatttttttaatgtagtgaaatatgtctaccatttcctacccaatttttttgaatccccaagcaaaatcttactgagaaagcatctattactttttattaaactgttccatgttaggtagagaggagaagatgcatgtatgtatttggaataaattctgcttctgaaaacacctatc

SEQ ID NO: 331690 - DNA, 1515 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggatcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 331691 - DNA, 1092 bp, Homo sapiens
ttccggtagtgagaacccttccggtgggctaggtactgagcgcgcgagtacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggatcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 331692 - DNA, 941 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacataaaaaaaaaaaaaaaaaaaaaaaaaaaaaaggggggggggccgggccc

SEQ ID NO: 331693 - DNA, 949 bp, Homo sapiens
  misc_feature (908)..(908): n is a, c, g, or t
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatcgatcggccgaaganattcttctaaaaatccctatcccgtctcaccactctagcaa

SEQ ID NO: 331694 - DNA, 953 bp, Homo sapiens
  misc_feature (896)..(896): n is a, c, g, or t
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatcangatgcgtgatgcacctactcaaatacttcgcaccccccacacaatcataagcgagcc

SEQ ID NO: 331695 - DNA, 875 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtggctccatcaattttcctcccctctttcttgggcaacccattctttacacttcggaaccccgcgtgtgtagc

SEQ ID NO: 331696 - DNA, 827 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaaaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacat

SEQ ID NO: 331697 - DNA, 688 bp, Homo sapiens
aaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagccctaaacaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacat

SEQ ID NO: 331698 - DNA, 1371 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagactgcgtggtctcgcctcactgcaacctctgtctcccgggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtccaggagaagtaaggaattttttttttcttttttttaagaggaagtctcgctcttgttgcccaggctggagggcagtgggacaatctcagctcactgcaagctccgccgcctgggttcacgccattctcctgcctcagcctccccagcagctgggactacaggcacacgccgccacgcccggctaatttttgtgtttttagtagagatggggtttatctgtgttggccaggatagtctcgatctcctggtctcgtgatccccctgccttggcctcccaaagtgttgggattacaggcgtgagccactgcgcccggccggaaaatttttttaatgtagtgaaatatgtctaccatttcctacccaatttttttgaatccccaagcaaaatcttactgagaaagcatctattactttttattaaactgttccatgttaggtagagaggagaagatgcatgtatgtatttggaataaattctgcttctgaaaacacctatc

SEQ ID NO: 331699 - DNA, 875 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaaaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacataaaaaaaaaaaaaaaaaaaaaaaaaaaaaaggggggggggccgggccc

SEQ ID NO: 331700 - DNA, 557 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggctaatttttgtgtttttagtagagatggggtttatctgtgttggccaggatagtctcgatctcctggtctcgtgatccccctgccttggcctcccaaagtgttgggattacaggcgtgagccactgcgcccggccggaaaatttttttaatgtagtgaaatatgtctaccatttcctacccaatttttttgaatccccaagcaaaatcttactgagaaagcatctattactttttattaaactgttccatgttaggtagagaggagaagatgcatgtatgtatttggaataaattctgcttctgaaaacacctatc

SEQ ID NO: 331701 - DNA, 364 bp, Homo sapiens
ctcgccctccatctccacgataacgggggggaacggctgtctgcagagactctcttattatccccgctacaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacat

SEQ ID NO: 331702 - DNA, 2029 bp, Homo sapiens
ttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggatcacttgaggccaggagtttgagaccagcttggccaatgtggtgaaaccccatctctactaaaaatacaaaaaaaaaattggccgggcgtggtggtgcacgcctgtaatcccagatacttgggtggctgaggcaggagaattgcttgaactggggaggcagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtccaggagaagtaaggaattttttttttcttttttttaagaggaagtctcgctcttgttgcccaggctggagggcagtgggacaatctcagctcactgcaagctccgccgcctgggttcacgccattctcctgcctcagcctccccagcagctgggactacaggcacacgccgccacgcccggctaatttttgtgtttttagtagagatggggtttatctgtgttggccaggatagtctcgatctcctggtctcgtgatccccctgccttggcctcccaaagtgttgggattacaggcgtgagccactgcgcccggccggaaaatttttttaatgtagtgaaatatgtctaccatttcctacccaatttttttgaatccccaagcaaaatcttactgagaaagcatctattactttttattaaactgttccatgttaggtagagaggagaagatgcatgtatgtatttggaataaattctgcttctgaaaacacctatc

SEQ ID NO: 331703 - DNA, 684 bp, Homo sapiens
ttccggtagtgagaacccttccggtgggctaggtactgagcgcgcgagtacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacataaaaaaaaaaaaacgaacaacaccaaaaaaaccacaccaacacccaacacaaaccgaaccaacacgccagccccaccccaacaaaaactttgttgcccccttggtcaccatcgcttttaaacttggggcagttcttttactggtgccccaattcgggctatcttggcaatttgcctactggggtgctcgcttcaatttacttggcgggcctcttacaacctccgctttgca

SEQ ID NO: 331704 - DNA, 785 bp, Homo sapiens
ttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 331705 - DNA, 1603 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcagaacgctgtctctggcttccaaagcctgctgcattccttggcccatggccccttccttcatcttcaaggatcagcaagggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331706 - DNA, 1083 bp, Homo sapiens
  misc_feature (1)..(1): n is a, c, g, or t
  misc_feature (16)..(16): n is a, c, g, or t
  misc_feature (19)..(19): n is a, c, g, or t
  misc_feature (21)..(21): n is a, c, g, or t
ncccaatttcgccacngtngncaaatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaaaaaaataaaactacatttttttatccttataattcaattatcggctcgacttgctatctaagtattatatccccacatttcacaaacaccacgacctaaagcggtggagttctctgaagctgcaagcaataaaagtctcccgcgcgaaaccctttcgcacgcgcaacaagtcctgctgaaaacgatgagcctatatagataggggggcagcaacaacacacccaaccctctccttataccctctccacaccggacagacacacggtacacactctacttgaacacccacccaggcacgccccaacacccctcctcccacttatcactcaacagacccacacctaca

SEQ ID NO: 331707 - DNA, 562 bp, Homo sapiens
caaagtcttgaggcccggggaaagcagcaacagttcttattgctaaactgcccaagcggaacggcctgtggaatccaaggcaaatgatagctgtaggtttccaagggacaccttcctcaaatggacaatattggaaccttattacatatagagcaagtgtggccactgtgacccatttgaagtcaaaatcatcaggagtgccctgacctggtaaaccgaatcgctaaatgcataccccgtttccgcaatataaaaatgtggggttccacgcaacctggttttcacttgagcttctggcacattggtatgtaaagcaaaccctgtcacatgcggcccttaggttgagcccagccagcccttgaatagttcatggcctgtccttaatagagattcactcctttccgggggaggagggcaggtacctgcacaccaacacactcctgtggataaggaaagacaatcgcttcgttttgttccctaccatcttttttttcagatgatgatttcattatggatttgtgggatttttaaaaataaagttttaatttttttcctggaaaaa

SEQ ID NO: 331708 - DNA, 1277 bp, Homo sapiens
gcacgagacagaaagtacatattatctcagtgttaaccgaaataaaaaaagtattgctgttaatatcaaggatccacaaggtgtgtcatcgagcttgcagctgtttgtgatgtgtttgtggacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331709 - DNA, 712 bp, Homo sapiens
aaggaaagcacaagagcaggtgagggcagccaagagacttggcagtggatttcaggcctgagaaagctgcttaatttcaaggataacctgaaggactctgcccttgagactggcccctggcctcacctgaagacagaggccatcagacatcccagcagcggaagcctggacagtctgaataaatgggaatagccttctggaaaatgaagaatgcttggatttgcaagaactgtattcagccaaggctggattatctgcaaagaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331710 - DNA, 609 bp, Homo sapiens
ctggatctctgcataggaagggtggggtagttcaggctgctgaactaaatgagtgggtgctctaaatgcctggagatttgcctgcatgtgaagcagagagggcctccctgtaccaggatctctgcacaggaaggatggggcatgtcaggctgctgatacaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331711 - DNA, 1972 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaaaaaaaacaaagaaaacaaacaaccgaaaaacatcaccctaacgccccgcgcatcactaaaagtactagtccctactggcagagcaacttcccgggtggatgtatttgatagacagccctattgctttcgcggtaagcatcggaaatggagatcattcttcgaacgccgccgatattggctatccgtcaggatacgacgcagtctctcacccccttcccgtcatcacagtctaaaacctagtatatgccgcgccgcccgcacttgattgctcatccaccggcactagtctagttgtgacacataactgaaaacgaagcgatttctgt

SEQ ID NO: 331712 - DNA, 2018 bp, Homo sapiens
  misc_feature (1815)..(1815): n is a, c, g, or t
  misc_feature (1929)..(1929): n is a, c, g, or t
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaaaagccccagacagggttaagcacaagatctattcacaggcaagcgtgtaaggggccgggtctgtccgagcgtccgtgtgtggctcgtccgcgaggaggggtgtccagggaggggccgttctggggggtgggttaggcagggccctgctagaggagcgtggggggtggcnccggggggtgagtaaggggtggggggtgtccgtttatactgggggtggggggggcgcgtgcggccatagcgcgcgccaaccggccacgtacggcccgagaaccagctagtgttnaggtgaggggtgtaatgatagggacttacacgccccccggtcccccgcgccccccctgtcccctgcgagcccggcagaatcagccgcac

SEQ ID NO: 331713 - DNA, 1404 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcactgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331714 - DNA, 986 bp, Homo sapiens
  misc_feature (865)..(866): n is a, c, g, or t
  misc_feature (885)..(885): n is a, c, g, or t
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccagcttnntaaacccaggatggctatnattgaagtggagcaggtaccacagagttgccaaccgttgcaagatcttgaattggcctgagtgaatgataattccgtttctaccacccttcgggacccctt

SEQ ID NO: 331715 - DNA, 406 bp, Homo sapiens
gcctggagatgtgcctgagtgtggagcagagaaggtctccctacaccaagttctctgctcgggaggggcaggatgactaaggcaagcatcctggagatttgcctgggcatggagcagaaagggcctctctgcatctggatctctgcataggaagggtggggtagttcaggctgctgaactaaatgagtgggtgctctaaatgcctggagatttgcctgcatgtgaagcagagagggcctccctgtaccaggatctctgcacaggaaggatggggcatgtcaggctgctgatacaggtgagtgggtgctctgaatgcctggatgtctgcctgtgaatggagcggcaagagctctgctgtaccacagtctatgcccaggaagggtggtgcggctcaggctgcgaaacc

SEQ ID NO: 331716 - DNA, 493 bp, Homo sapiens
tcttgctgttgagaagtcagcgttctaactgttgttacttcataggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331717 - DNA, 1646 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331718 - DNA, 1580 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcagaacgctgtctctggcttccaaagcctgctgcattccttggcccatggccccttccttcatcttcaaggatcagcaagggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 331719 - DNA, 1992 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaaaaaaataaaactacatttttttatccttataattcaattatcggctcgacttgctatctaagtattatatccccacatttcacaaacaccacgacctaaagcggtggagttctctgaagctgcaagcaataaaagtctcccgcgcgaaaccctttcgcacgcgcaacaagtcctgctgaaaacgatgagcctatatagataggggggcagcaacaacacacccaaccctctccttataccctctccacaccggacagacacacggtacacactctacttgaacacccacccaggcacgccccaacacccctcctcccacttatcactcaacagacccacacctaca

SEQ ID NO: 331720 - DNA, 1120 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctatatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccagatgaggaagagagtttgttacttccctgaggaaacacagcctgtaagcggatgagttggaatcggatgcaagtttggaaggaagtatcctctccccaaatgtggggcagagagacgcttgggctgacctaattgttaaagcctcagtcagtgttatgctgaatttgtcgcttacatgtctgcacattactttcaattgaaagtagaaaaatgaaatagagatctaataaacattaccacaatgttaagactgaaaaaat

SEQ ID NO: 331721 - DNA, 447 bp, Homo sapiens
ggtaaccggtccgaaattcccgggtcgactattataactaaattcgcgcccgcgtcgacatctttatatgtatagaagtactctattaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctctta

SEQ ID NO: 331722 - DNA, 1356 bp, Homo sapiens
acaagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctctta

SEQ ID NO: 331723 - DNA, 1424 bp, Homo sapiens
acaagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccctgggggtgaagggggagggttgagcgaaggtaggcgcgtccggggtgggatgtcggcgtttttttataggcgcccttgagtggggcgggtttttcttttggggggggtgtattgaatcttcggcaataataggcgcggcgggggggttggttgggcgaggggggcgcgctttcccaaaaggggggtgcttgcgtttcccaaaattggggggttttggtgagagtttggggat

SEQ ID NO: 331724 - DNA, 1413 bp, Homo sapiens
acaagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaagtggtccaaattatgtgtttataaaataaacataagactatagaattaaaaatta

SEQ ID NO: 331725 - DNA, 1309 bp, Homo sapiens
ggctggtaccggcccggagagtagggctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctctta

SEQ ID NO: 331726 - DNA, 1414 bp, Homo sapiens
acaagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagactgctgtggaattcctgagaaagagcaactgagggatagcaacatggatttcactgaataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctctta

SEQ ID NO: 331727 - DNA, 968 bp, Homo sapiens
acaagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattat

SEQ ID NO: 331728 - DNA, 485 bp, Homo sapiens
aatggtggctgtcagaggctggagagtggggagaatgggaagatgctggtcaaagggtacacgttccaggtagaatggggggaaactgagaggtgatggaaatgttaattagcttgattcaatcattccacattgtatacctgtactacagcatcactttatcaatatccaaagaaaaggtaccgctgaaatccttctccccacattacagtggctctgctgctaggcactgacaccccagcccacagcaggtgccaaagcagtaatcagaagctgataggctgatgacaaggctgtcacctcagctcctgggcagaccacgcacgcagtagggacagtggttctgaagaggtctaggcaggcagaggcagcgactgtatgccacatctgaatgaaacttcacattcccgagtgggtaactttctctaatgaagccaatgtaaacttgttactttgcctctgaggaaatctatgctggaacagct

SEQ ID NO: 331729 - DNA, 432 bp, Homo sapiens
gtccacgcagcgtttaagagctgtaacactcaccacgaaagtctgcaacttcactcctgaaactggtgagaccacggacccactggaagggatgagcaactccagagacaccgtctttaagagctgtaacactcactgcgaatgtctgcaacttcactcttgaagtcagcgagaccacgaacccaccagaaggaagaaactccagacacatctgaacatttgaaggaacaaaccctggacacaccatctttaagaactgtaacgctcactgtgagggtctgtggtttcattttgaagtcaccaagaccaagaacccaccaattctggacacactatgattatggggattgttctactgagacctttcttttgaaatcttaattggctctgggtattaatcagtacattctatacaataaaatactttctctt

SEQ ID NO: 331730 - DNA, 447 bp, Homo sapiens
tcttctttcaaggttaaggaagtattagcccataaatgggaggatatttgggggcaggggacgctggcctgctggtcactccgatacctcctggcttggtacagcttctcttctctccatccacaaatttttcaaagctacaaaggtctagggtttttctttttcacaacactttgggccttgtacgaagggacagggttgtgtggggaggcaggcaagactgtcacttgaacatcagaaactgtctgaggttttatttaatacgatacctttaggattccatttacagcaccaaatccaatttattgtaaaaccaatttcagtgatctgtgttgtggtcatgaaagagagagaaaggtcctctcaacaactagaaatactgactactttcagctggaggagctttttcttcctctgctcagcctgtgatagaggcaccagtaaatc

SEQ ID NO: 331731 - DNA, 403 bp, Homo sapiens
atggtagagctgtgacagtatctgcagtcccggcctggcccgggagaaagaaagaaagatgggagaggcagcgacacagcagcctccctttccagagcccaggacagtttagggcccaatttggcaatagttgatgtaggttggtttacgggttctattccccaaagcctcaatgcatcattaccaccttgcctcactcagccctcaactccccagtttgcgacccatttgagcctcccgggacgaaattacttcttcctccttctgcctgccattcaaatgctaatcaagtattgagaaaaagttctttccttaaaatcacttacatagtaaatgactggcagcctctcaacctattttgaggtatttatatcttctcaagttttaaggcaaatttgaagca

SEQ ID NO: 331732 - DNA, 393 bp, Homo sapiens
tcttgtctggtgcacagttcatgggtttctagtatctgctttttatttctgtaagattagtagttatatcccttctttttctgattttagtaatttgaatcttctttcgtcttagctgatgtagctagaaatttgtcgatttcattatcttttcaaagaaccaactcttgggtttgttgactgtatttttctgttttctctcttctgtcatctttgttactcctgtctgctgcttaggggttcagtgtggtcttcttttttctagtttcttaatttgaaaagttagtttacagctgtaaacatccctccgagtgcagccttcgctgatcccctagcgtcatcatttctgtttgtctggaggtgtttctgattccctctgatttcttgttggag

SEQ ID NO: 331733 - DNA, 490 bp, Homo sapiens
  misc_feature (340)..(340): n is a, c, g, or t
  misc_feature (361)..(361): n is a, c, g, or t
  misc_feature (375)..(375): n is a, c, g, or t
  misc_feature (380)..(380): n is a, c, g, or t
  misc_feature (408)..(408): n is a, c, g, or t
  misc_feature (415)..(415): n is a, c, g, or t
gcccaacacaaagaaaacgatttctattttggaaatggcaaagtacaccctgatatgtattgggttaaatggacattctttttctgagggaagcagcccggtgactgtagctcaaaaaaataatttttaagagtagaagtcatcaaaaaggaacaagcaaaaaagtgctataagaagtttgattctttgtggatacttggagataatccttccctttgtgaaatatgttcaattaaaaaaaaagatgattgaagaaattcaacaaacaaaaatctttgtggtgatataagaagacctttattttattatttatttatttagtattatttattattttttngagacagggtctcactctgtngcccaggccagaangcaangccacgatctcagctcactgcaaccttngcttccnggatcaagtgattcttcaacctcagcctccagagtagcagggactacaggcgtgagccatcacgcccagctaatt

SEQ ID NO: 331734 - DNA, 460 bp, Homo sapiens
ctgactgcaccctccacctcccgggagtcaagcgattctcctgcctcagcctcccgaatagctgggtctacaggcatgtgccaccacacctagctaatttttgtatttttagtagagacgggggtttcatcatgttggccaggatggtctcgatctcttgacattgtgatctgcccgcctcggcctcccagagtgttgggattacaggcgtcagccatctctccagagctgattttttttggagggaggggtttgaattacttttttctttctctctttagcatcattgtagacccatggatttttatgtatccaatgtgtgtttttggttttttaaattttgagacagtcttgctctgtcacccaggctggagtgcagtggtgtgaccttggcttactacaacctccgcctcccgggttcaagctattctcctggctcagcctcccaagcagctgggat

SEQ ID NO: 331735 - DNA, 425 bp, Homo sapiens
gccccaggggtcaggtgttggcacttggaccatgccatgaaggaagggaccagttgggtaagctgagacaagtagggatggatttcgaatggagagaccaatgtgaacaaaggtcctgaggcgatagtggggaacgccatgctgggggagactgtgggacacccatgggtgatgtggagacgtgggttggagccagtgttggagtgaggttggggacagagcctgggaacccctggaagagaccggaagagcctggctgaggccttcaggcctcatcctgatgggaaatcagtgtggggctttgggttagagggatcaggacaatcattgtctcaggcagagggtgaagccactgtgcatgctgggtgggaacagggagagagtgtttcaaagaccccctgcagcagtccaggtagcagctggtg

SEQ ID NO: 331736 - DNA, 496 bp, Homo sapiens
ttcaagtccagcctgggcaacatagcaagaccccagtctctgattttttttaacttgttttttcttgttattactatctgtcagctgcaagagctcttcccagttctctgtgtgctcctctctggcaagtgataggctagctacctttctgagagctaaaggaggatatacagaagtagaaaactttttgttgccctcacatgggcttcttcaactggtccttaagcagggttcgaaactaggggaaaaccttatgcatgtctgatggtcacactggagactgggtccatatcaggacacaagtgccatttgtccttgagtctacagagctggaagattcagcctctcaaggagctcatggtctccatggtgagacaggctgtaagcaaaaatagtttaatcaaaatgcagaatagcatgtactaggggccaggtagacaaacagattatgtgttacagaatcgagaggaaggagagaccactgcaggctggagga

SEQ ID NO: 331737 - DNA, 612 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatgggtgggggtcgggagtggtgagggaagggtggcgcatctcagagccctcgcaaatttctggccagaaatgtgggggtatgggcgcagcttggccaaggccatgctgcaagggccaggtggccgtccttcctcactcctgtctggcctccctctgcagggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaagatgaggaaacggagggctcggagatgaagtgattcgcctaacgtatttcatccactaaatcgcagtgtgggaggagctaataaaatacattttgcatgc

SEQ ID NO: 331738 - DNA, 2782 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatgggtgggggtcgggagtggtgagggaagggtggcgcatctcagagccctcgcaaatttctggccagaaatgtgggggtatgggcgcagcttggccaaggccatgctgcaagggccaggtggccgtccttcctcactcctgtctggcctccctctgcagggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 331739 - DNA, 4453 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctcccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaa

SEQ ID NO: 331740 - DNA, 4402 bp, Homo sapiens
gggctgcgggccgggccgcccgccctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctcccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaa

SEQ ID NO: 331741 - DNA, 2382 bp, Homo sapiens
ttgtgatcttcttctccccatccctcaagaggaaggtgccccggaaccggatcgctgagatgaagaagtcgcactcgtccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 331742 - DNA, 1804 bp, Homo sapiens
caaagccaggctgagtccacagagccagtgggcagaagagactggctggggacccaggcccggccctggcgcctgcctgggtggacctgctgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 331743 - DNA, 2494 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtc

SEQ ID NO: 331744 - DNA, 1046 bp, Homo sapiens
gggctgcgggccgggccgcccgccctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggagctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 331745 - DNA, 1187 bp, Homo sapiens
  misc_feature (1069)..(1069): n is a, c, g, or t
  misc_feature (1099)..(1099): n is a, c, g, or t
  misc_feature (1132)..(1132): n is a, c, g, or t
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggacctccttcagcacaaccccaccccacaattttatgacttccatttcgcaattgttgaattataactgcgactgnaacaaacaggttcatagagatgaatttttngagaaacatatatctacatgttgtataattggnttttttttccatgtaagtgaacataaaaacgccttttccgggtgctttcttcaaa

SEQ ID NO: 331746 - DNA, 1052 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggacctccttcagcacaccccataacccagaacgtaacatccttcatgaattccacgtag

SEQ ID NO: 331747 - DNA, 493 bp, Homo sapiens
tggcgcctgcctgggtggacctgctgggtgagcgtgggcacgtggccggccttccccggtgagtcagatggggatgatggtgactgagggtcagccagcgcatgcagaggcctaggccacccagctctttgccccgcggtttgtaggaggttctgctgcaggagaggcgttcctgcctcgcacagccggaaaccagacttgccagcttgccccaggtcacaaggtctcttgggatagcactgggcttggggccctgctctgcctaggccactctccttccccagggcgggaggctgaggtcagcagcagctttgttcccagaagcctttggtggggcacaggcaggagaaggtctccagcccactggctgctttgctctacctggttcttccagagggactgcccagagctgtagttcttggaagagtacaggtgtgctgggcaggggggtgcccttggcacaggtccaggggcagtcttgcccagccattgt

SEQ ID NO: 331748 - DNA, 283 bp, Homo sapiens
ttgtgaagtcccaacaactcgacagggtgggtgttcttaccccttttacagatgaggaaacggagggctcggagatgaagtgattcgcctaacgtatttcatccactaaatcgcagtgtgggaggagctaataaaatacattttgcatgcttccttctctgtttttcacaagcttttgctgttcgtaaaatgtttaatcaactccatatgccagacatggaaacgcttttgttttccttcaaaaacaagaaatgagagggccgtgtagctaggtctggaactt

SEQ ID NO: 331749 - DNA, 2575 bp, Homo sapiens
gggctgcgggccgggccgcccgccctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 331750 - DNA, 4609 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatgggtgggggtcgggagtggtgagggaagggtggcgcatctcagagccctcgcaaatttctggccagaaatgtgggggtatgggcgcagcttggccaaggccatgctgcaagggccaggtggccgtccttcctcactcctgtctggcctccctctgcagggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctcccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaa

SEQ ID NO: 331751 - DNA, 4418 bp, Homo sapiens
aagtttaaacactagtttgtgcgggtcgtcggtcgcgcggcctggggtggcgcagagccctcgcaaatttctggccagaaatgtgggggtatgggcgcagcttggccaaggccatgctgcaagggccaggtggccgtccttcctcactcctgtctggcctccctctgcagggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctcccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaa

SEQ ID NO: 331752 - DNA, 2957 bp, Homo sapiens
  misc_feature (2823)..(2823): n is a, c, g, or t
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcaaaaaaaaaaaacaaaaaaaacaaaaaaaaaatcctccggggggaatctatattgcggggtcgcgggaaaaagagaggggtattgagaattgcgggcccattggcgccaatacccggtgntcccgtagcaccagcgttttctctgtcgtcaccaagggtgggaaaactcctcgccggggtcccccaatataggggaggcggatttaatttcccaaataaccccaggtgtaacccggcttatggagcgagagaac

SEQ ID NO: 331753 - DNA, 1634 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagggggccttttttcccctggtgggggcttgttcgggcctgcgccccgagaaattgcccccacccaattttttggaaggcctttgtgccacaaaaaagta

SEQ ID NO: 331754 - DNA, 1400 bp, Homo sapiens
ttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgacagtgcaaccaaactgagggctcggcctgtgggggaccggacggcccggtcggccggctgagcgaacgagcgaagaaacttcttctcaaggacaataaccagtcaagtgccggggtcggattaacaaccccggagttgggaaactccgaacaaagggggtagcgggaaccgcgggcacccgagggcagacacggccgcccgtgtgagcctgaagacagagcacacggggcaacca

SEQ ID NO: 331755 - DNA, 836 bp, Homo sapiens
gggctgcgggccgggccgcccgccctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggagctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtc

SEQ ID NO: 331756 - DNA, 295 bp, Homo sapiens
ggccatttaatcctcttcccctcgtgcatatgagagtttccatattttatttaatgagaaatttttgttcaaaggtatctgactttgtaagctataacaagtcccttggaaccaaaatcagacccctgagtcctcagctttttgtcctggcttctctcagtgactttcttctccattagcatatcaacgggtaggcatggaaattctgtgctttgccccctattgaaaagtcaatctctgctgtgaaagttaagatttttatttgagatcaaaatacgtcttgtggcaagttaaa

SEQ ID NO: 331757 - DNA, 303 bp, Homo sapiens
ccttgtgaaattttgtattaacagaattgaggctggattatagttttggcaaggctctgtcttcctctgatttacttccattcctaggccatacttttccagttgttccagatgaaagcctggggtgttcagtgtagcccattcctctggtaggtcctgaaatctaatccttctctgcttagcaagatgagaatgcccaaaactcattttgtttaacatgttcctttgttttctttacttcttttgaatgggtagttagttttagaggcttggttatatttaattccccagaaggcacgcaat

SEQ ID NO: 331758 - DNA, 419 bp, Homo sapiens
atggaacacattaaaacatcagaacagaacctcaggtagttacagtagagtgatcatgtcatctcttaagccagccaaggtatgaaattaaaatattggctagtcttaaacatatagaattaatttcaggaaggctttgtcaatacttgctggatatttacagataatctaatagcatacactttttaaagctacatgactcatagaagtcaatgtaaaagggggtaagatggttttgtttgagtgtagcaggtattatttacatctctggaagtgttgctgataagagataggtttgaatctgttcattacatatgaatattggttgtgttttttttcaaaaaattatatggttgcagtttgaattttgaaatcaatttactggtgatgtcagcattttataaccctgtggaaatgaa

SEQ ID NO: 331759 - DNA, 1944 bp, Homo sapiens
cacacccagcttggacattccttttttagtttgttctgatttgaattataaaacccatctcagtgtaggaattcagagtcattctagaaggggcttccattaaaaattaaagggagcaaaagaattttttcacgggtattagctattatgttcctttgttccagtaactttacctggtgaagattaaccctgaaaccagcctagaaagtagattcatttcccagaagcttttaaaaaggaactctggagccaaatgaaattgggttgtgagtttaatgaaaatcaggcagaaggccccaaaaaagcctaactgagcctgtttcttcctcttccttcctgtgttttcaaggaaggatacctatgtgaaataatttggagggtattttttatagactaaggtttgtgttctcttagcccagagacacagagaaagttaaagatggaaggtacataggcgcagaagagttcaaacttcattacagctttgtcttagtgatgcttcctccctcctctcatcactttctctgaaatagacaaaattggtcacaatataagacagtgtttattgatgcctgctaggtttcatactcattatcttctgaaactttatagcaaatagggagcaaataatctgtcatttattaaatggaaaaataaaagatgaagaaaaaagaaaaatgaaggcttagagcaatgtgtaaattgcagctaacaggagacaaagttatgaagcatgaaatgccaattctctccatctttcccttcagcattgattccttccttacatattgtagttaaaaaaaaaaatcagttatcacaaacaagttctgtgtgacctacaagaaacagctaagcatgctaaaggatttttgtcttgaaccggaggcatctccgtgggcggcagggagatgcatgggcggtgggtggggttcggggttcctctggcctttcaaatgtgtgcccttccctgtgcttgcttttccacctggtaaactacctagggattagcagctgcttcagttctcttactgtgtttttgtctttgttaatgatcctgtgagaattctttctgtaagttctttactgccatttccttgtgtagagagagttttgtccttttgtttttcaggtacttctagttctgtatctttgtggatgtttagctagagccatactgtgtttttttttttccatgtctgccccatctgttgaaacaaaacagatcttctatgtgtgctgtcagattgtttttagaaagcaaccgaggttttacacttatgttcttaagactcatgttttacagcatgcagaatacactttattttctgaagctttttgtttttgtaagccagataaatgacttatttagttgtaatttgagatataatggaattataattatcttaaaattattaggctaaatagttgattgtatttatttaaaaactacttttttgtactttttaataacaatacttgtttgggaatattctgttaactccttttcactgcagtaaatctttgtcttcttttcagtatgagaatttccacaaacagctctaaatgcaattttctccctgctcagccttttctatcatatagcacacttgtattataatttatcaatttgcatttgcatatgccatggccaagtggtgatctttgagaggttttggtaggtaagaaaggaggactctatgcatgtgtgatggcagtcgggggtggtaatttgggaacacttcatctacctttgttcctttgtttgtactgttttctttaacctgtggaatgttttcccacttcccctgctcaaatcccaccagccaacagcttcttcagctacaactgtagcattcctctgcagtctctcctttgtctactttctttcatagtgactgcatctgacctattcttggcatgccatatggaatgatccagtcctaa

SEQ ID NO: 331760 - DNA, 581 bp, Homo sapiens
ctggaatggggtatctgtaaccaagacagattaaaagcagcagcatatgggtttccagccttcccctcttctgtttctctgtggtcctcaactaaagaatgaatcatgactattctcccatactgttttagctactcagtgacaccgcactgaaacttgatcctttttacactgtggacatttctttaatattttttttcctaagtagagacagggtctcactacattgctcaggctagtcttgaactccgggtctccagcaatcctcctctcacctcagcctcctcccaaagtgctgggattacaggctaacaccccagcccacccccacccccgcttttttttttttttttttaaagagatggagtctcactacgttgcccaggctgacctcaaactcctaggctgaagcgatcttcccacctcaccctcctgagtagctgagatgacaggcatgtgccaccacacccagcttggacattccttttttagtttgttctgatttgaattataaaacccatctcagtgtaggaattcagagtcattctagaaggggcttccattaaaaattaaagggagca

SEQ ID NO: 331761 - DNA, 473 bp, Homo sapiens
ctcttccttcctgtgttttcaaggaaggatacctatgtgaaataatttggagggtattttttatagactaaggtttgtgttctcttagcccagagacacagagaaagttaaagatggaaggtacataggcgcagaagagttcaaacttcattacagctttgtcttagtgatgcttcctccctcctctcatcactttctctgaaatagacaaaattggtcacaatataagacagtgtttattgatgcctgctaggtttcatactcattatcttctgaaactttatagcaaatagggagcaaataatctgtcatttattaaatggaaaaataaaagatgaagaaaaaagaaaaatgaaggcttagagcaatgtgtaaattgcagctaacaggagacaaagttatgaagcatgaaatgccaattctctccatctttcccttcagcattgattccttccttacatattgtagttaaa

SEQ ID NO: 331762 - DNA, 527 bp, Homo sapiens
ccttctcacagaggacaccttgataagagcatgttgctgtgatgacttgtttccttgtctgcctctcctccccaggaggtggaaagtcctagagacagaagttctatctacttttgtgtctttagctctagcacagggcctgctgtagaataggcatttgatacatagttgttacaggaatgaaataacaaaggataagatggatttaaatttctaaattatggggttcctttatgttttgaaattttgtcaatcttaaatcgtgatcagtacacaaatgtctgatgagtcttgacttgtaagctccagtctttgtagaagtgtgttttcctgtgagtttttgaagtgctgtattttattaactggcattatatggattttgctcggtagccagcatgcagaagcataactggcagaagtggccttcccatagggagtgcttgacttttaatggattattgtcacaaggtgtataggttgatttcctcaaaggtgagtgatggtttctttctcaggaagacaggtga

SEQ ID NO: 331763 - DNA, 2144 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331764 - DNA, 389 bp, Homo sapiens
ggtgagtagttgtctttcccagccccatatgagcccacgtggcatgccctgtccatagcctcttatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331765 - DNA, 414 bp, Homo sapiens
  misc_feature (16)..(16): n is a, c, g, or t
  misc_feature (404)..(404): n is a, c, g, or t
tgatctagaggatccnaagctctggaaaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtccagagcttgggatactcaggaatcanctatcacgaa

SEQ ID NO: 331766 - DNA, 892 bp, Homo sapiens
accaggacacatggggagccgagagaaaacagtatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttaaaaaaaaaaaaaaaaaaaaaaaaaaaaaaaaaaaaaaaaaaaaaaaaaaaaaaaaaaaaaaaaaaaaaaaaaaaaaaagggggggaggctcgaaaagatttccctctcgaggggagcacacgttatttgatggcagacacacttttttttgagaggagggggcgcgccatactgatagcgactgtataatgatacacgtgactgagggggcgggtttatatatagagacgatgtgattggggatgaaaagagttatgaaagaggcctttgtttagatgggagacgcgccatcccatacactctctggcggagggagggagcagcccacaagttgtggggaggaacaaactattcctcacgcgaggaaagattattgatagagatgacagctcacggcagagataaaatcaatacacgaagaccttctcggcgacggctgttttcgcggctggtttgtgtgcagaagagagcgtgtagtgagatttgatggcttggagtaagaatagaacaacttggatcgccgaagctgagcag

SEQ ID NO: 331767 - DNA, 2678 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttaaaaaaaaaaaaaaaaaaaaaaaaaaaaaaaaaaaaaaaaaaaaaaaaaaaaaaaaaaaaaaaaaaaaaaaaaaaaaaagggggggaggctcgaaaagatttccctctcgaggggagcacacgttatttgatggcagacacacttttttttgagaggagggggcgcgccatactgatagcgactgtataatgatacacgtgactgagggggcgggtttatatatagagacgatgtgattggggatgaaaagagttatgaaagaggcctttgtttagatgggagacgcgccatcccatacactctctggcggagggagggagcagcccacaagttgtggggaggaacaaactattcctcacgcgaggaaagattattgatagagatgacagctcacggcagagataaaatcaatacacgaagaccttctcggcgacggctgttttcgcggctggtttgtgtgcagaagagagcgtgtagtgagatttgatggcttggagtaagaatagaacaacttggatcgccgaagctgagcag

SEQ ID NO: 331768 - DNA, 2318 bp, Homo sapiens
tccttgaggcgggcccgggcggggcggttgtatatcagggccgcgctgagctgcgccagctgaggtgtgacagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331769 - DNA, 2107 bp, Homo sapiens
aggaaggggatggtaggagacaggagacctctaaagaccccagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331770 - DNA, 2268 bp, Homo sapiens
tccttgaggcgggcccgggcggggcggttgtatatcagggccgcgctgagctgcgccagctgaggtgtgacagctgccgaagtcagttccttgtggagccggagctgggcgcggattcgccgaggcaccgaggcactcagaggagaaactgcaagttgggacttgtccctaggaaaatccagttgctgccaaggtcgtgcagtcactcagccctggagtcaagccagagcaggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331771 - DNA, 2326 bp, Homo sapiens
tacctggtggcaaacaggaccctggtccttgcttgcaatagacttgcctttgttgacattatgcttgcccttcagttgcctgctctcccagtgaccttggtgtgccaggctggctgagctctgctggtgggggtcaggcctcctgtgggaaggaagcaggaagaccagctggaaggagtgagagagaccctctggtaggaagacgtcacctgaggtgacacagcaaagcccggccaggtaacatagtgtctaatctccgccgtgaccagggccttccttgtatctctgctgcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331772 - DNA, 2706 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagggagaaggggaggcaagatactgcgggaggccgcctgctgaggatcgcctttgcagagaacattccagccagcaccaagccattccgagcgaacagctgacggtcacatgatccaggcctttttctctgctttgaacggaaggcccaggatagtgtggggtttggcagtagagcatttggcctggaacccactagggaagagcttgtgtgtgtgtgtgtggggagtgctgacgtagtagtccacgccctaggctccacccccccgtactgccaactcagtaaacaaataagaagggagaaagactggagggatgccacggctactgctcttcaaggggcctgagttcgattccctgcaccgggtggtccacgatttcctataactaactccagcttgcggggtgggggtgggggaatctagcctctctagagccctagccctctgacgaggaggaggtgtagtgccctgtagcttttccccaggacccgccacatgtccctttgtctggggaatgatgccctcaccctctgcatctggctgacttctgctgtctctcctcagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331773 - DNA, 1474 bp, Homo sapiens
  misc_feature (13)..(13): n is a, c, g, or t
  misc_feature (26)..(27): n is a, c, g, or t
  misc_feature (31)..(31): n is a, c, g, or t
  misc_feature (1464)..(1464): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtccagagcttgggatactcaggaatcanctatcacgaa

SEQ ID NO: 331774 - DNA, 1819 bp, Homo sapiens
  misc_feature (32)..(32): n is a, c, g, or t
tctagaggatcgccaagaacagacactctggnggtggggcaggcctgtggttggtcactgccgtcaggaacccctcaagagacagagtggacgttccccgagttcttcctgttctcagcagtcggccccattggccccagggaagggtgtcctggccccccactgtcttcctcagttgggcagctccgccgcgtcctcttcttcttggcctggctgacttctgctgtctctcctcagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331775 - DNA, 1026 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtacccttttgggaggggggggggggttccttcccaattgcttggccacaaggcgggtttttg

SEQ ID NO: 331776 - DNA, 1318 bp, Homo sapiens
  misc_feature (65)..(65): n is a, c, g, or t
tccctccccacacccacccacccccctccgacggcaacctaggtaggtcgaggctgggtgttgtnttctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331777 - DNA, 1084 bp, Homo sapiens
  misc_feature (16)..(16): n is a, c, g, or t
tgatctagaggatccnaagctctggaaaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331778 - DNA, 988 bp, Homo sapiens
agcatcctggctctgccctggacccagctcctccccactcagttcctccccactcagctcctcctcccttagctcctcctccctcagctcctcctcgctcagctcctccccactcagttcctccttcctcagctcctcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331779 - DNA, 358 bp, Homo sapiens
accaggacacatggggagccgagagaaaacagtatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331780 - DNA, 1032 bp, Homo sapiens
tccttgaggcgggcccgggcggggcggttgtatatcagggccgcgctgagctgcgccagctgaggtgtgacagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcagggtgacgcgcagccggagtggaagcagagttttggcgggcgagcagcgccttgcaggaaactgactcatcactactccctccagcggtccgaggctctgcccacgcacctcccaccccgcgcgtgatttcctggaggccggcgccccctcccggccctggcgggaatagcacacaggctttcccgcggagtggggctggccggcgcgaaccgccgcggctactcctgggctcatccgagatcaacccctatgccattaccaccccttcaaaggagcactccttaggttcaacagtattcactgagctcttactggaaattaaaatatggctgaagtctaaggcaggaaggccaataaaggaggctatttttaattgtttctaaaacaagggtttgcgtttctgagttttctttgggctgaaagttattatgagcatgagagcagattttgatgggggaggagaggcctatgagagccataagagaaggaggggtggtagaagaggagagggtgcctgcctagatcctagtcctgtcttgaactcccgagagccagggaatatccagcaccttgatgaagccctaggcgggcgcctcctccttgtgcctatgatgtattgagacccagaatgtccatttcaaacataccagtgtgtctccgcttggctggcaacccaagagtgcccatctgaggaattgtgccaaacacttgcttgaatcttcaatctggattaagttggtctcggg

SEQ ID NO: 331781 - DNA, 288 bp, Homo sapiens
tgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacaggtgcggacatgtgcacggaaggactttgtaagggaccaggattctcagaatccatggtccaagggctgacctgtctggtcctggtccagcatgctccaggtagaaggaaacaggcccagagaggggaagcaacctccctgaggtcac

SEQ ID NO: 331782 - DNA, 2177 bp, Homo sapiens
tccttgaggcgggcccgggcggggcggttgtatatcagggccgcgctgagctgcgccagctgaggtgtgacagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331783 - DNA, 2242 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttaaaaaaaacagtcacccaacaccaaacatacaacaaccaaacaaagaccgcaagcacgcagacaggcacaagcgacgcacagacgcagaacaccaaaag

SEQ ID NO: 331784 - DNA, 2088 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagccccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331785 - DNA, 2082 bp, Homo sapiens
tggcatagaagaggctggtggctatttgtccttgggctgcctgttttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331786 - DNA, 2225 bp, Homo sapiens
aggaaggggatggtaggagacaggagacctctaaagaccccagttaggtcaccagacttctctgagccccagtttccccagcagtgtatacgggctatgtggggagtattcaggagacagacaactcactcgtcaaatcctccccttcctggccaacaaagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331787 - DNA, 3040 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacaggtgtcttaactctgttggccagactggagtgcagtgatacgatcatggctcactgcagcttcaaactcctgggctcaagcgatcttcctacctcagcctcctgggtagctgggaagctgggactatagttgtacaccactacgcccggttaattttttgagtttttgtagagacaaggtctcaccatgttgcccgggctggtcttgaactcctgagctcaagcagtcctcctgcctcagcctcccaaagtgttgtgattacaggcgtgagccaccatgcccagccccttgccatccttttagggcaaggaaaccaggctcagagaggtagagtgatttatctaaggtctcaaagtgaatttgccgttgggtcaagactaattataataacaacaactactgacgtttatatgggcccggcattgtgctgaacactttcatggattttgtaacagaatccctagatcagcactgtccagtaactctgcagggatgggagtgtccggtacaggggccacgagccacatacggctgttgtgcatttgacacacagctcatgtgactgaggaactgaattgttcattttatttgattgtagtctgtttaaacaagcacacagagctagtagtggttcctctgctgggcagcttgacttagagcagacccatgggtgcgggtgcggtgatggataaaatcacatctgtgaagcatggtgggacactccataatacccctcaagagacagagtggacgttccccgagttcttcctgttctcagcagtcggccccattggccccagggaagggtgtcctggccccccactgtcttcctcagttgggcagctccgccgcgtcctcttcttcttggcctggctgacttctgctgtctctcctcagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttta

SEQ ID NO: 331788 - DNA, 698 bp, Homo sapiens
  misc_feature (13)..(13): n is a, c, g, or t
  misc_feature (26)..(27): n is a, c, g, or t
  misc_feature (31)..(31): n is a, c, g, or t
taaatgcaggctngtacggtccgganntttnggatagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggaccagcctggccaacatggtgaaatctctactaaaaatacaaaaattggctgggcatggtggtgcacgcttgtaatcccagctacttggaaggctgaggtgggaggatcacttgaacccaggaggcagaggttgcagtcagctgagatcataccactgtactccagcctcttccagggtgacagtgagattcatctcaaataaatacataaataaaaaactgtttggtaatatcttctaaaaaaacc

SEQ ID NO: 331789 - DNA, 337 bp, Homo sapiens
aacactgttttcccacttcttcagaagatggtatttgccagaactattgtaaatgcacagaggaaaagctaataatttttttaacttatgatggatgccttaatacaggattctcctattttaacttgcatcagaataacctggagggcttgttaaaacaaatggctgggccccaccctcagagtttctgactcagggacactgctgctgctgctgatgctgctgatcagggaaccacacacttttaaatcactatttatgtaggtctttagggcttaattctcttgaagagcctgggttaagaaagtcgagaagaactgagagcaagacagataag

SEQ ID NO: 331790 - DNA, 464 bp, Homo sapiens
taatgaagacagggcaacaaaaccaagcaaattcaagacaataaataaagcgctctttggactgcaaatgaatgtggcatcaatactataagaacactaaacttttcaataatgttgtctctaaaatcaaaacacctcctacattttagtatacaagaggatgtgcataggtcatacacaattaccataccatatcatgtaagaaactcacctgggcacagtagcttacgcctataattccagcactttaggaggccaaggcaagagtatcacttgagctcaagaccagcctgggcaacacagtgagatcctctctacaaaaaaatatttttaaaaaattacccattcaaggctgcagtgagccatgatcatgccactacactccagctgggacaacagagaccctgtctcaaaagaaagggaggggatcggggggacttaagtatcaatgcacggttgatgtc

SEQ ID NO: 331791 - DNA, 356 bp, Homo sapiens
tgtggataaaacattcatatactaaactttattccctggcagtagaagataaaggaggcattcttatgccagaagaaggaagtacaatctgtgtaggcgaatgagcagaatggagtagctgatgcagtagaaggatgatgtggtggaataatctgaggtgatggtgctgacgtttgccaaaaactcgctatgtatcgtatctggactggttgatttcttcatggaaaaccttgccagggaggactgggaagacgtgctgagcaaagtgccagagtcagagcctgtctcttcaaggtggggaggacttctgtgccaagaagtgaccttgggggctctctttcaaggatggccaaagc

SEQ ID NO: 331792 - DNA, 218 bp, Homo sapiens
cccccagttcttctcccagaagccaccactacaatcagcctcctgtgtgtctactccaaaatccggtgtatgattttacaggcagatttgcaagtctgttctgcaccagagagtttagattttatgtggcaaatgatggaacagtatttcgtttctttcttttttcttgtttcatagagacagggtctcgccgtgttgcccaggcagatctcaaactt

SEQ ID NO: 331793 - DNA, 769 bp, Homo sapiens
ctcccaaagtgctgggattacagacatgagccactgcacccgcctaagaagataggaaagtcttgcaagaagtgaagagcattgaagacagaaggaactgtctgaaatagtttggtatatttagaaagcgtcaagtattttagtaaggcaagaatataggatgtgaatgagtatttggacaaagggtaagcaaccattcaggggcctgtatgtttactatgctaagaagttccgacatcatcctgtaggcagccacggtgtgttttcaacagggaatgacgtgtgttctgtgttattctggaagcactgtagaggatgatttagaaagggtgcaagattggaagcaaaaagacaatacgaaggcaagagatgatcagagtgtgaaggaatgagatttgacaggatccagctacagaatagttgtgaggcatgggggaaagggaggaatgcagcatttttcccaagtgtaagagccttagctaattgatcaggtgctattcagaagagggagcagtttgaggagaataataaatgcctcttagatcctgtgacttaaagtttcctttgtggcatctaagagagatgttctataggcagaatgtaggagtctggagcttagaggaaaatatgaacagatgagagttttgggagtcatgcatacaggtgattgatgaagttgcagaactggttatgattgcccaataggaattatgaattgaagaactagaagaccatgtacagagtcttgggagaatgcctacattaaggg

SEQ ID NO: 331794 - DNA, 241 bp, Homo sapiens
ccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttataca

SEQ ID NO: 331795 - DNA, 220 bp, Homo sapiens
cgtgctgggctttggagagatcacaacacatgacagctcttactgtcatggaactcagtgatgtttcgtgcatgatcatcctctccacttgtttattgacattggaggtggcatatgtgatgtccctttttctaaaaaattttctcctaagactgtctgtagtctttctttacgtaatcatatctgacatgggtcaactttgttgctgccaccctagccc

SEQ ID NO: 331796 - DNA, 1917 bp, Homo sapiens
caataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaa

SEQ ID NO: 331797 - DNA, 2132 bp, Homo sapiens
caataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatat

SEQ ID NO: 331798 - DNA, 735 bp, Homo sapiens
ctcggagcggcgctgcgctgcgccgaggcgggcgggcgggcgggcggagcggggcgggcggagcgcggcgcgtggggctcgccattagccgtcgctccgcttcgccatctcgggctttgtctggcgactcgctgccccggcgtcggctgcagcggagctgcggctcgactgttcggcccgccgtgctcccaggtgcccccggcctgcgctcccatccacacgctcggtaagtgagcccgggagccgcggatttcgggggagaggggttgctacgagtggcggcggcgccgatcttcatgcgcccgggcaggcctggagaaccatgccgggctggattgaaccggctcccacagcggcccctccgccggagcccgtcgttcccttgccgtttccggggtgtaaagagcaacggggattttttttttttaatgcagaggttttagttttcgggtttttttttaagtttcgtatgtgccgttcggcaaggagaggaccgcgaggtaggcaccgaagctggacgccgcgatcggcgtgcgtgcgccccaaaccagcggccacgctccgggggatgagggtgggcgcggaccgctcgctccgggaggcgggagagagctggcctggaagccctagtctgagctgggagaacttgggggagagctccggagcagggctgtgggcgccccccgagcctccccggacgccgggggcacctccgggcaccctctccgcggccgc

SEQ ID NO: 331799 - DNA, 3830 bp, Homo sapiens
gccagacaaagcccgagatggcgaagcggagcgacggctaatggcgagccccacgcgccgcgctccgcccgccccgctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaattcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331800 - DNA, 3515 bp, Homo sapiens
gccagacaaagcccgagatggcgaagcggagcgacggctaatggcgagccccacgcgccgcgctccgcccgccccgctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagttggcttagaggtgtctgcctatgcttaaagccaactgtggaagttttgttttcccttttttgtataataaagtgaaaaacaaaggtt

SEQ ID NO: 331801 - DNA, 4571 bp, Homo sapiens
ctccgccgcgggagggagctgcggctgtgccggccgagcgggggagggcgccgccactcagagccagggagggagccgctggagcgggaagcccggaggccgcgctgcgccggggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331802 - DNA, 3700 bp, Homo sapiens
gccagacaaagcccgagatggcgaagcggagcgacggctaatggcgagccccacgcgccgcgctccgcccgccccgctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgaaaaaaaaaaaaaaaaaaaaaaaaaaaaaaaaaaaaaaaaaaaaaaaaaaaaaaaaaaaaaaaaaagaggggggggcgcggccaaaaagaaaaccccgagggggggcgccaagggcgagcgcgcgaccccgcggttttgtgtgtgttaaaagaggggggtggccccactatagaggggcggctcttttatatagagaggacagagagagaggtcgggagcgggggtgatattaaacagcgcttgttggacgtgtgggagaaaacagttttcggtcgctggggtgggtgactctctttggtgggaggaggagacacgacgcataatatgttgagtgggggagggggggaaaaaatagtgtgtgggggaagatattgctccgtacagagaaagtaatgtaaataagagggcgccgactagagggagggagataatgtataaagaattgttgttggacgggggtgttgaaatcagtggggtggtgataacaaaacaagatagggtagatagattttgatggtggtgggcggggggtgagaaagaggaagtgtggagaagcatctggtgaggagtatgtgggagttgcgagaaaagaaaatatttttagccg

SEQ ID NO: 331803 - DNA, 4684 bp, Homo sapiens
ctcggagcggcgctgcgctgcgccgaggcgggcgggcgggcgggcggagcggggcgggcggagcgcggcgcgtggggctcgccattagccgtcgctccgcttcgccatctcgggctttgtctggcgactcgctgccccggcgtcggctgcagcggagctgcggctcgactgttcggcccgccgtgctcccaggtgcccccggcctgcgctcccatccacacgctcgggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331804 - DNA, 4970 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331805 - DNA, 2486 bp, Homo sapiens
  misc_feature (56)..(56): n is a, c, g, or t
  misc_feature (58)..(58): n is a, c, g, or t
agaggatgacgaggacgaagacgacgacgaggatgacgatgagcatgaagataatnantccgagggcagcagctccagctcctggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331806 - DNA, 2621 bp, Homo sapiens
ctccgccgcgggagggagctgcggctgtgccggccgagcgggggagggcgccgccactcagagccagggagggagccgctggagcgggaagcccggaggccgcgctgcgccggggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaaaaaggctgaaggaagctccagactcaatgtgacccccaggtggcatcgccaacgcctgcctcgtgccacctcatgcttataataaagccggcgtcagagaccgctgcttccctc

SEQ ID NO: 331807 - DNA, 2531 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccaggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgaaaaaaaaaaaaaaaaaaaaaaaaaaaaaaaaaaaaaaaaaaaaaaaaaaaaaaaaaaaaaaaaaagaggggggggcgcggccaaaaagaaaaccccgagggggggcgccaagggcgagcgcgcgaccccgcggttttgtgtgtgttaaaagaggggggtggccccactatagaggggcggctcttttatatagagaggacagagagagaggtcgggagcgggggtgatattaaacagcgcttgttggacgtgtgggagaaaacagttttcggtcgctggggtgggtgactctctttggtgggaggaggagacacgacgcataatatgttgagtgggggagggggggaaaaaatagtgtgtgggggaagatattgctccgtacagagaaagtaatgtaaataagagggcgccgactagagggagggagataatgtataaagaattgttgttggacgggggtgttgaaatcagtggggtggtgataacaaaacaagatagggtagatagattttgatggtggtgggcggggggtgagaaagaggaagtgtggagaagcatctggtgaggagtatgtgggagttgcgagaaaagaaaatatttttagccg

SEQ ID NO: 331808 - DNA, 1621 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggaggtattggcatggaggttattggcat

SEQ ID NO: 331809 - DNA, 1209 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgcacaccgcggcaaagtacaaaccccccaaaagccaaaaaaa

SEQ ID NO: 331810 - DNA, 4649 bp, Homo sapiens
gccagacaaagcccgagatggcgaagcggagcgacggctaatggcgagccccacgcgccgcgctccgcccgccccgctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331811 - DNA, 4147 bp, Homo sapiens
gccagacaaagcccgagatggcgaagcggagcgacggctaatggcgagccccacgcgccgcgctccgcccgccccgctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctggggataatacgggatcctctagat

SEQ ID NO: 331812 - DNA, 4991 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331813 - DNA, 3445 bp, Homo sapiens
ggagaaggacgcctatcacaagaagtgtgatcagaaaaagaaagattacgaggcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331814 - DNA, 5429 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaaggtgagagggcaagggacccttggaaggaacagagaggcatcagactaagccagcaccatcctagcctggcccatccacccacttgtgctggctggtctcattcatgatttcattccatgccctcgcaatccttcaggataacggtcactatcacccttttatttttatttttttttttattttttgagacatgcactccagcctgggtgacagagcaagaccctgtttcaaaaaaaaaaaaaaaaaaaaaaaaaaaattagagctgtgttctcagatcccaggggctctctgcagagacccaaaatctagggagcctgggaggggtaagatggggtgatgatatataaatgctcagcccactgcctagcactgggccagcatgctcagtcagcagtagttggctatgttccaacccttgccgcttctgtctcccccagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331815 - DNA, 3354 bp, Homo sapiens
caagactgggctccctggcagcacccacggaccccgaccctctgcacctggacagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331816 - DNA, 4457 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgactgccccacagacctggaaatggccgcccccaaaggccaagaccgttggtcccaggaagacatgctgactttgctggaatgcatgaagaacaaccttccatccaatgacagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331817 - DNA, 3270 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttattttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtt

SEQ ID NO: 331818 - DNA, 2113 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggcacggtcaggcccgacgaggcggcggtcaagccagcggaaggaacccgggggagcggagaacgggcaagccgcccagtcccaaaagccgggactgcacaagagaactggatctggccgtcagatacgtgagctaaacggaaaccggaactgcagaagacgggggtaaggcggacacggtaagagagagagccacgaataaaaaaagagaagccagaaacagaaggcacgacggagggccaaggacgcccagaccccaaacaagc

SEQ ID NO: 331819 - DNA, 1453 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgagagatcatgggagaccacatgtgccctcctggagctgacacagatggggagagaacacacctggtgtgggaagctgtatggga

SEQ ID NO: 331820 - DNA, 939 bp, Homo sapiens
cggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgtaatcctacaaggcaataactcaagaacaccgtagcttcctaccggtcagtcc

SEQ ID NO: 331821 - DNA, 3625 bp, Homo sapiens
ggtagcggcggcggcggcggctagcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatacagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaaggtttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcgcccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataagga

SEQ ID NO: 331822 - DNA, 1560 bp, Homo sapiens
ggtagcggcggcggcggcggctagcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatacagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaaggtttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatggtaaggaagctatgcatgcaggacctacccaccggatgtcttcgagatgattttaacatctggtcaactagtgcca

SEQ ID NO: 331823 - DNA, 3679 bp, Homo sapiens
ggtagcggcggcggcggcggctagcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatacagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaaggtttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcgcccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataagga

SEQ ID NO: 331824 - DNA, 267 bp, Homo sapiens
tctcttagggaagaggactggccctgtacttcctgggtctgtgaaattcagggctccatgagcttggataggaaaaaaatggcatcttcattttcactaagctgtacctggaatttagcatttctttccattacgaatgtggcaatgagcctgtgggttcatcaggacccaggagtttgccactaagagaataaaaaaacagactttccgtctcacactgtaactgcagacactttgagatgtggtttattcatcactgcattaaat

SEQ ID NO: 331825 - DNA, 269 bp, Homo sapiens
atagacagttttatttcttcttttcaatctgtatggttttctttgcctttttcttgcctattgtactggctaggacttccagtgtaatgtttaatagaaatcctgagactggacatccttgccttattttcaatctgaggagaaagcattcagttgttcatcattaacagacaatgttagctgaaggtttttcagagcttgtgtactctaccaggatgaagaaggtcccttctatttccagtttgctaagagttttaaaattgtgaatg

SEQ ID NO: 331826 - DNA, 274 bp, Homo sapiens
cccatcactcactcccactcaggccccagccctaatgtcgccttttcagaggggtcctgactgcccaaaataaagtaacgtctccttgctcttcatcacatttctggaaaattctaggagtgggtgggaaagtcataaatgtcctgtctcagagtctgaccctctggaggcctcagattggcccccagctccttccagactccagcaaggtccccgggaagctgacatgtgttaagtgccaggtccctctgtcatctgtactttgcaactgggg

SEQ ID NO: 331827 - DNA, 196 bp, Homo sapiens
taaaatctctctcaaacatcccactttattatctgccccaaacatttctcacccagattattatgctaccattctactcatcttcaagatcctgggcttaataatacctcatccacacatttgtccagagaagtccttctaaacagcagtgaagagaccactcccctacttactataacccactttcaagacaaaa

SEQ ID NO: 331828 - DNA, 420 bp, Homo sapiens
gaggttaggggaaagagggaatggtggtggcagagagaggttttcttctgcatcccagaagaaaaactcagcaaaaaataagcgttaggagttcatttttagacatgctgggcttaatggtgcctaatgggcattcgggccagcaaggagacgtgaagcgtggagtggctcaggagctcttctagtctagggaagcggatgcctttctgaacctaacttatacaggcgattttataagttactctgagctttccatgggtggcctcatatcctgtcagtgactcacgtgttcaaccttgatcaccaatgttttcctcctagagtggtttggtcaagtgggctagccctgggggtaaggaggaatttgttttctttatggcaggctgcagctagactgagactcccttaggtcatctactc

SEQ ID NO: 331829 - DNA, 449 bp, Homo sapiens
ctgagttcagagtgagccactaccacgtggagaatgggaaagtggagaagttagtgcaagacaggagcttaattcccaatgacagagtgatcatttggggctgttctttaagaagaagatcagtgcctccctcactttaagcagtgcttctagggttttctaggaagtctagaaaacacacacagatcccaacaagaatggacactgatgggtgaggacagctgctccctgaggagatggccactgggcactgttggcacatcattctgggaaatttcagtttagagcttattagaagagacccagacactaaaggtcaaaggcgggacatgaggagcacagggagagggatgtctattggcattcagagatctgttatactgtcaactaaaccgctctctgaatttgagcattatggtcatacattatgagaggaaaaagatcaacac

SEQ ID NO: 331830 - DNA, 130 bp, Homo sapiens
gacaaatggatggacaggtggatggatgggtgggtggatgaatggatgggtgggcagatgaatggacagatgagtggatagatggatagggtagatggatggatgacggaagagaaaaatgaacagatgg

SEQ ID NO: 331831 - DNA, 295 bp, Homo sapiens
gtggtatggtaacgtacgtgcttctttattagatcattatctatgggtctaataattattttgaagtaatgttgaatgtaatgtgatatgaaaatatctgcaatccctggtaataataaagatactgctgatttgtttcctatctggtacaactacacttaaccaaataaaacagctaggtgtttctgctaagaaacactgcgtggtaacgtttcccggatagcccaaatgatctctatcttctggtgtttacaccatgtgtagtcccttctcacaatataccatacaataaaag

SEQ ID NO: 331832 - DNA, 580 bp, Homo sapiens
ctatgtctaatggtaagaaagctgagactcagagaggttaggtaacttgttacaaagtgagcaaacagataaccaagactggaacccagatctcttgactccaaatgttagatttttcccagtctaccattttgctttgtcttgaagcatagtgccaggaacttgttaggtatttaacaggtgtttgtcaaattaatgtataactatatatgtggaatctcctatatatcttttttctatagtgaaattctaaaagtatctataattggtagctggtaatggtcttgctcactagctataaacagctagaaaaaatgagtaatatatatgatacatctgttttcacacattggatgatacaagatcatgctccaagagagaaggtaaacaaatggggtgagccctatagtcaactcaattttcagtctgggagcactttctggaatgtggcatagggagggggaacccaagcaaagcttgaaagtttcactgagttgagaaaacaaagagaggagtttgggaaggcctaagtgacttgaactgcaaggtagagtatcagagaaaagggagataagcccag

SEQ ID NO: 331833 - DNA, 279 bp, Homo sapiens
cctaattatactataatagaatttcaaaagaatcttttttgaattagaaaacatcccctctacttgctgcataatatcctcttcggtcctctatactaaatgagtccatttggaaagtaaggaggggtataaattaccttttttccaggaatcaacaagccaggtttttactccattatcatatgtcctgttttgttttactaaatctcttgtacttaaataaggtttccgcttaatcagtcaccagaaaagagagcaggatttttttttaattaaaat

SEQ ID NO: 331834 - DNA, 768 bp, Homo sapiens
tccagcctgggcgacagagcaagactctgtctcaagaaaaaaaaaattatgatgatggttgcacaattctgtgattaaactaaaaaccactgaagtgtacacttttaattgagttaattgtatgtatgttaattagatctaaacaaacttttttttaaggttaaggctttacaaaagaaataaaaccaaaacaagaaaagggataaaaatataggctctaatcatgtggaaatccttagacagttaatttttaaatggcatgaaaaagaaggaaattgacaaagagcctacaaaactttgagataattttctaggaatctggggttcccaccgtgaagtctcctcaaactccttagcatatacagttctgaggcttagagaagtttcagaaagaaaattcttccaatgaacctacagcattgaatgccaaaatacccatgtttgtttgggtttttttatttattcattttgagacagggtcttgttctgttgcccaggttggagtgcagtggcacaatcatagctcagtgcagcctcaacctgtcgggttcaagcaatcctcctgtctcagcctcccaagtagctgggactacagatgcgtgctaccacttccagctaatctctttattttatgctttgtagaaactgtccattgcccaggctggtctcaaactcccaggctcaagcaatcctcccacctcagcctcccaaagtgctaggattacaggtgtgagccatcgcatccatcccccacttttactattaagt

SEQ ID NO: 331835 - DNA, 143 bp, Homo sapiens
gcggctgatctttaagaagcaccccacgctaggcaggcattttcagatagattaaacctatttgcaaaatgcggtaagatcgctaattagtcatcactgctttcagctgagaagagtgaggccatggattaactaacattcca

SEQ ID NO: 331836 - DNA, 2602 bp, Homo sapiens
tacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggacattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaatagtctcttttctcaagtacaagctaagaaatgctcataataataaaataagagaatgtagaatgaggagttagagtgtatatgtatgtgtatacaatttttgatagatggtattttgttatttcatatctgtgttgaaaacagtcttttagtttgtcagacatctttttcagtacctgctatgtgcaggcaggtattgagaaaggtctgagaatactgagggttaataagagatggtatattctccagagaaataaataccactaaagtataagagcagatgtcctttttggaagaatgcctgtggtgatggaataagaaaagccatatagaggggtgaggaaaagcttttcttaccaagtgtgtgagctgagttttggaggatgattaggcaagagttagttggcctggtggagaaacaggagccagacattcagctggaggaacaggagtgtggaacagtgtgggtaacacaatggggtgtgtctggtttcagaattataagaaatagtctttagggggaacagaaatgaaggagactaaatagatgatgataaattatctgtgaatatgtactggttcctacatattcaaagtgtgctaagtttgtacagccattacttgtaaggttctaggagttgtctctctaggggttggtttgtaccatagtccattatgtacatctagaacaattctttctttcccggaactgagcccaaggtgggctttctacagtgcacctctggctctggggcagctcaagcaatcagaaagaactgaggcactggtagaaaacaactctgaggatgaacaggataatgttcctgaagtggaatgtggtatcccttcatggttaaatggttgcatacttcagggtcacctatggaaaggtgtcctcagggtagctaaaagtggttaatttccttgtgttttgacttacagatcatttctaggtggacttggggaaaataaagttacttataaaaatattgcttcattggcatttggaggtgttgtattgaaggaggaagtgggttcctatcaccagaaccctctctaggtgtttcagataggaaactgggttgtagaccttgtcccagtaatatctccagcagctccaacacattttgtcaacttcgtattcgttttttaagtttttttccttgctgttggccacctttaccttcttttttttttttttccttctttttcccttattttttgagacagtctcactctggcgcccaagctggagtacagtggggtcatatcggctaactgcaacctccacctcccaggttcaagcgatgctcctgtaatcctagctattcaggaggctgacgcaggagacttgcttgaatataggaggcagacgttgcagtgagccgaggtcacaccattcactccagcctgggcaacaagagcgaaactccgtttcaaaaaaaaaaaaaaatgacttggacttgtggtgaggggaggtcatctgtagactcctggacctgtttttgccttacttattctctaaagactgaaatatttcctaaaatgtatgggcactgtttaccagaaagtaccttagttaaaacataaaatcatttatgccttataaagctatattttttcaattgctttactgagtcataggaggctaataaatttgtgtaaattgtcta

SEQ ID NO: 331837 - DNA, 1142 bp, Homo sapiens
aaaaaaatctcactctgtcacccaggctggagtgcagtggcatgatctcaggtcgctgcaacctctgcctccagggttcaagcaactctcctgcttcagcctcctgagtagctgggactacaggcatgcaccaccacgccaggctaattttttgtattttttagtagagacagggtttcaccatattggccaggctggtcttgaactccagacctcatgattcgcctgcctcggcctcccaaaatgctgggattacagatatgagccatcatgcccagccgcaaccctaatttttcattcagtcataataccaacagttatctcatgtacctctgagtgccttcttcccaaaagccagcagtaccatacctgctgtcagcaagtgtgtaatataccatagtgataaatatgaccaaaagccataaatgactgtgagatgtatgagaatgacacgtcacattagtaagaagagaaaaattttggccatgtttatgatttgaaatatgttttcctctatcacatttagaaatatagttacaaaatgcccttagttttatcctgattcatcatggtcactgaggagcatcgtctcatatgcctggtatgtgacatgtgtctcttcaacagtaaaagacttggcattggctgggcatggtggctcacgcctgtaatcccagcactttgggaggccgaggtcaggagttagagaccattctgaccaatatgatcaaaccccgtctctactaaaaatacaaaaattagcggggtgtggtggcatgctcctgtaatcctagctattcaggaggctgacgcaggagacttgcttgaatataggaggcagacgttgcagtgagccgaggtcacaccattcactccagcctgggcaacaagagcgaaactccgtttcaaaaaaaaaaaaaaatgacttggacttgtggtgaggggaggtcatctgtagactcctggacctgtttttgccttacttattctctaaagactgaaatatttcctaaaatgtatgggcactgtttaccagaaagtaccttagttaaaacataaaatcatttatgccttataaagctatattttttcaattgctttactgagtcataggaggctaataaatttgtgtaaattgtcta

SEQ ID NO: 331838 - DNA, 438 bp, Homo sapiens
attgtcaatagtagaaagggcagagcctcttctgccatctggagggttgagcgtctcccagctccctggaactttgggatggtttcgggcccctgtgccccatggcacgtggatgcttcaaggctagtggggacagtctcttctgcttttgtggtgactcaaacgacactgtgttcttaggggaaggaatggggactcggggccgtttaatgccccctccgaagtgggcatagggcctggacatccacccgttaattaatccattaaagggcaaatcaaccgacagcctccttattatacaaaaaaggggaacagttttgttaattcattagctggttattaagtgaaaagtcccgagtcctgttggcatttaacatcacagaaggaaatccccagaaatgctgatttctttgggatttccacatgccaaatgatttt

SEQ ID NO: 331839 - DNA, 668 bp, Homo sapiens
gagaacaacattgcatgcaacagtttagcatcactcttttcaacctagtagacaaggtccataaaggaagacaggctgaaatgaaaaggaaaacaaactaaagtagtagtatatgtatattagaaaggaaggcagaaaaaagttacttcaggaaaaacgggagaaaatataggagaaggaattcacttggttaaaaaaaaaaggaaaagaaaactagatatgaacaagtgcagtacaaaaatgaagaaatgtataagagagtaggtaggcttgttagagcccccagagtgaaaaaaagaaaaggtagaatatcaaaagaaagtttataggaacaagctagccaccatcaatcacctttgtcctctattccaatcatctcctaactggataatctgctgcccctctctgaagctctctccatgtagcagctgatgacctttttttttgggtggcagggtctcgctctgtactcccaggtgggaatgcagtggtacgatcatggctcactgcagcctcgccctcctgggctcaagaatcctcccatatcatttttttatgtttttgtacagacacgggctcactatgttgctcaggctggtctccaactcctgggctcaagcaatcctctcaacttggcctcccaaaatgctgggattacaggcgtgagc

SEQ ID NO: 331840 - DNA, 183 bp, Homo sapiens
ggctgagacaatcatttattaaatccataatatagtatagctgatagactcctttttcactggaacatcctatccctttacagatgttctccacgcaccttcatgactccctggacagctagcaggcctccagttttatagggtgactactaaaagtatttgattgtctccgtcattcacaca

SEQ ID NO: 331841 - DNA, 2159 bp, Homo sapiens
catcatggcggccgcggggtttggtgtctgtgcctgagcagcgctggagccggagccggttcccgggtcctgcggctgaggagcccctccgctgtccacggcccctaccggcggggggcggctgggtccctcggcggagctcgggagatgtgactgcctgagggcggtggtggtgtcagcgtccggggccgggggagggggtgtctcgggcagagacccccgggcttggggcagctgaggcggccgggcctcctctacacggggcccgccttccgctgtctgggccgcgagagtccttcgtcccttacagccccgccccggctttgggacactgcgggtggtctgtttcccccagcttgggacaccccgttttctgaggcgtggaagagcgtcgccccggagtaagctgcccgtgccgcgccccgacagcttccctcagccccaagccgccccttattccggatcccggccccaactttggccacggagcctcccattcaaatccctcccttgctgtcaaggggtctccccttcccccaaggtggctcccgcgagcctctaatgccctgacttcttccaatgtcacctacggcccccttagtctcagctcagccaaaaactttaatgcaaaggaaaagtctggattggttccacaggccttttaaaaagcggacttaaaagttgctggcaatgcattccttttcgtcagagtcgagggcaaactcgctgaaatctgggtgacccgtgtccttttccggagagcaaagcagagaagcgagagcggccactagttcggcaggaaatttgttggaagatgaagaagctaagatagggggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatggtgagtgcttttcaaaatttctgctcatggttttcctcatgcattcatcttaggccttcaaggaactttgaacaacagtacttgcgacagttccttccaattccacttaataaatttgttactgtagttatctcttagtggaactttctttgtataagaaaaagttacttcgtgacttcggctttattcaaaatctatttgagttgcttatttcttgcctgattcctctgctaattcactgttgaccttggacaagccactttactgttccagggctttagtttcctgaggggctggacttcagtggtttcttagggtccctggttctatgattctgctctaaccgaagtcgtgggctcttctgacaagcatggattctttactgctttgtctacagagagcttttatcatattctcaaagtggtttgtgttcctgagaaagttaagaatcatagatactggttgacgctaatatccttgaccttttccttcgtaagtaggacttgaaaatactcactttggagccatgtgggaaaaatcaagtggggaagcagcattccttgtgaattttagatagacagcttctgtcttaccttccataaggagtaatctcttcctcgttgatgaagctttcatcctgtcttctccctgtttagaatgatatttgggccaataaaggttatctgtgacatttttatgaacatatttggcatttgaatgctgcccgtacattttatgttgttcatgtcc

SEQ ID NO: 331842 - DNA, 279 bp, Homo sapiens
  misc_feature (27)..(28): n is a, c, g, or t
gcctactactactactactactaaatnngcggccgctcgacacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331843 - DNA, 203 bp, Homo sapiens
gagagagagagagagagagagctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331844 - DNA, 6628 bp, Homo sapiens
gccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaactaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331845 - DNA, 5379 bp, Homo sapiens
gagaataaaactaattttttctcccaattttctcttcctttttcttttttctgttcccccctttctcttccagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331846 - DNA, 4993 bp, Homo sapiens
cagcagaagtgatcttctaaacactctgtcctgtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331847 - DNA, 6598 bp, Homo sapiens
gccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaactaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagaagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331848 - DNA, 3218 bp, Homo sapiens
gccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaactaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331849 - DNA, 484 bp, Homo sapiens
agtgctgggattacaggtgtgagccaccgtgcccggcccctaatttttgtatttttagtagagatggggtttcgccatgttggccagggtggtcttgaattcctgacctcaaataatcctcccacttcagcctcccaaagtgctgggattacaggcgtgagccaccgcacccagccttgtcctggtcttctgatgataaagagcctggtaaaatgtcagagcctgggctgctgctggggccatcccttctgaggtctgctgcaaaggtaactgattttaaatgtagtgtagtgaaatgctacacatcttgaacagcctttctctttcggttttctttcagcatttggagtattgctttgggaaattgctacctatggcatgtccccttacccgggaattgacctgtcccaggtgtatgagctgctagagaaggactaccgcatggagcgcccagaaggctgcccagagaaggtctatgaactca

SEQ ID NO: 331850 - DNA, 564 bp, Homo sapiens
atatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgc

SEQ ID NO: 331851 - DNA, 424 bp, Homo sapiens
gtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgccgggggtgccc

SEQ ID NO: 331852 - DNA, 5749 bp, Homo sapiens
  misc_feature (25)..(25): n is a, c, g, or t
ggccttccccctgcgaggatcgccnttggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccagcggagacgcggccgccctgggcgggcgcgggcggcgggcggcggtgagggcggcctgcggggcggcgcccgggggccgggccgagccgggcctgagccgggcccggaccgagctgggagaggggctccggcccgatcgttcgcttggcgcaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331853 - DNA, 6715 bp, Homo sapiens
catcatggcggccgcggggtttggtgtctgtgcctgagcagcgctggagccggagccggttcccgggtcctgcggctgaggagcccctccgctgtccacggcccctaccggcggggggcggctgggtccctcggcggagctcgggagatgtgactgcctgagggcggtggtggtgtcagcgtccggggccgggggagggggtgtctcgggcagagacccccgggcttggggcagctgaggcggccgggcctcctctacacggggcccgccttccgctgtctgggccgcgagagtccttcgtcccttacagccccgccccggctttgggacactgcgggtggtctgtttcccccagcttgggacaccccgttttctgaggcgtggaagagcgtcgccccggagtaagctgcccgtgccgcgccccgacagcttccctcagccccaagccgccccttattccggatcccggccccaactttggccacggagcctcccattcaaatccctcccttgctgtcaaggggtctccccttcccccaaggtggctcccgcgagcctctaatgccctgacttcttccaatgtcacctacggcccccttagtctcagctcagccaaaaactttaatgcaaaggaaaagtctggattggttccacaggccttttaaaaagcggacttaaaagttgctggcaatgcattccttttcgtcagagtcgagggcaaactcgctgaaatctgggtgacccgtgtccttttccggagagcaaagcagagaagcgagagcggccactagttcggcaggaaatttgttggaagatgaagaagctaagatagggggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331854 - DNA, 6782 bp, Homo sapiens
gccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaactaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaaacaacaacacaaagaagcccgagggcccaaaagccgggcgcgcgacaagagggcaacgaacggccctggccaagcgggtccctgacccaaggctggcacaagggagaccgcggcccctaaaggacgcgatattcgaaagccggtaaccgtaggg

SEQ ID NO: 331855 - DNA, 6454 bp, Homo sapiens
gccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaactaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331856 - DNA, 4318 bp, Homo sapiens
cttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331857 - DNA, 2307 bp, Homo sapiens
gccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaactaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccattagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 331858 - DNA, 260 bp, Homo sapiens
tccccacaaaaaacatcttaaaataacgtagtgaaccaattttctgataggtaatgtactaggtctcttctaattagcactaagtttcagtagcacaaatataaattttgtgactacataatgaaaatactggctcaatttttagaccacagaaatcttaatgagaagttaaaaacaaaaaccagaactacttcaggaaaagtgttttacaattagtgtgccttcttttttgtttttttttttttctttttgagacggag

SEQ ID NO: 331859 - DNA, 219 bp, Homo sapiens
ccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgat

SEQ ID NO: 331860 - DNA, 355 bp, Homo sapiens
tctgagcttgcagctttttggtgtggcttgagggctgttgagtgagctgttttagtcctttttagtctttgtttagtcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331861 - DNA, 2270 bp, Homo sapiens
gatgatgtcagggcggtgctggtgttgaagtcgtgcaggggcggtggtggagtgaggagttggactggccggcgtgttagcaggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331862 - DNA, 2793 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcaggtaggccgggcgctggtacagcttcctctagggtgttctctttggggttactctttttctccccatcagtgtgggagctccctgccttacctctctggaaaaaaatttgagccacattgtagccaccacaacttggagccctagggtttgggtggcctggactctttccctctgggagggtggcggcttggatgctacctgctctgcggggctggggaggggcagtcgggccagacttgtgtccagccactggaacccctctctgcgtatggccagcgcctctggcctgagttgacggagctcttcctgtggccagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331863 - DNA, 2566 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccagaagcagctcgtcccagccctgggctcctggctgcccgcccaggatacctgtctgactcaccctgggcgctgggctctggctgtttccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331864 - DNA, 2336 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttgtgtcgagtgagctgccccagcccctcccagcccttgcccagcctgggggagtggggaagccttgggcatggcccactcccccttgcccagcctggggga

SEQ ID NO: 331865 - DNA, 2219 bp, Homo sapiens
tgcggcaccggttgtaactgtcaagttgagggacgggttatattatacgatacgtgggcgtggggccgacagatctgaacatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331866 - DNA, 2590 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331867 - DNA, 2198 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331868 - DNA, 2013 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaagggtggaaggagggagaggatcaggaacaataagtaatgggtgctggagacttaaa

SEQ ID NO: 331869 - DNA, 2674 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattccccctacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331870 - DNA, 2241 bp, Homo sapiens
cgagtctccacaaatgtgacttgctcagttcccggcagcaccaggactgggcccagggtcccagaaccttgagtcagggcttagctgggagctgacctatctccagagagtccattctggtccctcaggctgtcttggtgcggacatgaatccctcatgccccctcccgctggcccttggcagtgtattctgagcagaagctccagagaggaaagagcccgcggagatggggccagcgttcacggcagtgacaagagctgggatgaatcccggcgtctcctacctgctgcctgcctggggcagccttctttgcactttggtggaggaagggtgcagtggaattggtccccgtttctcctgggaggggccttcaccggagctgctctcaccacagattgagtgccatctatggggggacatatatgctgaacaaacctgtggatgacatcatcatggagaacggcaaggtggtgggcgtgaagtctgagggagaggtgagcccttcccgtgcatgcagtgcagtcccatggttgaggcggggcttggtcactttctctgtgctgtcgagtctcctgctgcacagccccaagggtcttggagctgggaactgggggtccagaagtcttcagagtcatgactgtgggtgagaggtctctttcagaggccacatgccatgtctgtggtgcagaaagtgttcttgatcacagtgcctctggggggcgggggggcgggcacccagcccgtgcgtcaaggcccacctatctgagcggcagggtagggccatgcattcaggaggggcagtagtgatggctccgaggaacgtcttgtctgccagagctgcctgcccttgctgtgagcgcagccccacgtctacctaagggagggatgtgacaggggcgaggacttctggtgccttctcaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331871 - DNA, 1121 bp, Homo sapiens
aagggagaagagagaaggaagggaggggagggagggccacactatgacaagacagccccttctattcgtcactggcttcttccaaagcagctcgtcccagccctgggctcctggctgcccgcccaggatacctgtctgactcaccctgggcgctgggctctggctgtttccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331872 - DNA, 2477 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331873 - DNA, 2943 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaaaaaaaaaaaaaaaaaaaaaaaaaaaaaaaaaaaaaaaaaaaaaggggggggggggccaaaagagtatctcccccaagggggagcgccaaagtataagcagtacaccaaggtttttgtggacaaagggggcgcccaaaaaagggagaggcgaatattaaagagaaaaggacgcggaccgggagttatacaaagcggagaaggggagaaaacacggtggacagggggagggacccagggagagagggcccccataaaccgggggggggggggcacacatattgtggggaagagatcaatccaggtaagagaggtattaaagaaggcattgaggaggagaattatgagagactgtaacaggtgtgaatatgtggttgtgtaaccacgaggtggtaaattatagaggtctgagtagaaaaaggtgctggcacaacgggggagtattgttataagagaatttttatcccgg

SEQ ID NO: 331874 - DNA, 2560 bp, Homo sapiens
  misc_feature (2523)..(2523): n is a, c, g, or t
  misc_feature (2551)..(2553): n is a, c, g, or t
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaaaaaaaaaaaaaaaaaaaaaaaaaaaaaaaaaaaaaaaaccgggggntttttttggggggggggaaaaaggggtnnnaaggggc

SEQ ID NO: 331875 - DNA, 2862 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaaaaaaaaaaaaaaaaaaaaaaaaaaaaaaaaaaaaaaaactggtgggggcgcgcgcccggggcccttgaaaaagctttttaaaaccaattcgcggtgggcgcgcgcgggggcccacggctagggcaacgggagaaaggggaaaagggggtccccgagagggaaaccggggccagggaaaagaggggcggggaatcttacacacaataaaaaaagcccgcggggggggaaacacgaggaaggggggctgtgagaaaacaaattcccacaagagggggagagccccgagaggggggcaacaaacaggggggcaccataaccacaacaggaggaggcacaacagcgagagcccagaaaaactaaaatttaagccccacgtcatgggggc

SEQ ID NO: 331876 - DNA, 2904 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtgagcccttcccgtgcatgcagtgcagtcccatggttgaggcggggcttggtcactttctctgtgctgtcgagtctcctgctgcacagccccaagggtcttggagctgggaactgggggtccagaagtcttcagagtcatgactgtgggtgagaggtctctttcagaggccacatgccatgtctgtggtgcagaaagtgttcttgatcacagtgcctctggggggcgggggggcgggcacccagcccgtgcgtcaaggcccacctatctgagcggcagggtagggccatgcattcaggaggggcagtagtgatggctccgaggaacgtcttgtctgccagagctgcctgcccttgctgtgagcgcagccccacgtctacctaagggagggatgtgacaggggcgaggacttctggtgccttctcaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331877 - DNA, 2466 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttgaagcagcctagtacctgtctcagagtccgcggtactgctgaaccacacaaaggggccacgaccggaggtggcaacggaccaacccaagtgcctgccatgcctccctagtgggggaacctcactggagagatgggccctaccccccaagattccaaccacacacacagacggggcaccctagcccaacccggcgccgccccacacaggacccacgcgcccccccacgcgc

SEQ ID NO: 331878 - DNA, 2709 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattccccctacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331879 - DNA, 2140 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccagcttcccacaatccgcgtgtggaagaggggccttcgcaagtgatcctccccatatctatgataattgccatgcacgagcgcgcttcggggcggggtgtgaggaggctgacaccttgaccactacaa

SEQ ID NO: 331880 - DNA, 2797 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaggcctccactgaatccccgagacatcgccaagtgtctgagccaggaaggcccttagagcccatccaggccaatcccctcttcatccagatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattccccctacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331881 - DNA, 1814 bp, Homo sapiens
cgagtctccacaaatgtgacttgctcagttcccggcagcaccaggactgggcccagggtcccagaaccttgagtcagggcttagctgggagctgacctatctccagagagtccattctggtccctcaggctgtcttggtgcggacatgaatccctcatgccccctcccgctggcccttggcagtgtattctgagcagaagctccagagaggaaagagcccgcggagatggggccagcgttcacggcagtgacaagagctgggatgaatcccggcgtctcctacctgctgcctgcctggggcagccttctttgcactttggtggaggaagggtgcagtggaattggtccccgtttctcctgggaggggccttcaccggagctgctctcaccacagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331882 - DNA, 1768 bp, Homo sapiens
  misc_feature (1712)..(1712): n is a, c, g, or t
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccgcacatccgtnctggcccgacacatccgtactggcccgacacatcgtactggcccgacacatccgta

SEQ ID NO: 331883 - DNA, 1427 bp, Homo sapiens
  misc_feature (1371)..(1371): n is a, c, g, or t
  misc_feature (1396)..(1396): n is a, c, g, or t
  misc_feature (1417)..(1417): n is a, c, g, or t
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcaggacatctaacgtgtggcatgatctcctatggcacaacaacgntgggcggggcccaaggggcaaggtncaattagcctaattggccaangcaacttaac

SEQ ID NO: 331884 - DNA, 1385 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaa

SEQ ID NO: 331885 - DNA, 973 bp, Homo sapiens
  misc_feature (936)..(936): n is a, c, g, or t
  misc_feature (964)..(966): n is a, c, g, or t
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaaaaaaaaaaaaaaaaaaaaaaaaaaaaaaaaaaaaaaaaccgggggntttttttggggggggggaaaaaggggtnnnaaggggc

SEQ ID NO: 331886 - DNA, 793 bp, Homo sapiens
ttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaccaatctgatgggcattttgagaacgcgcttccgcagtagacgttccgagatcctgtagagtcacct

SEQ ID NO: 331887 - DNA, 102 bp, Homo sapiens
ctctaccttgttcaggtaagcttcatccacatccttcttgatgaggacaaattcattctccatctctgtacgcttattgatctcatcctcatacttgttctt

SEQ ID NO: 331888 - DNA, 452 bp, Homo sapiens
agtctcgctctgtcacctaggctggagtgcagtgacacgatctcagctcactgcaatctctgcctcccgggttcaagcagttctcctgcctcagcctcctgagtagctgggactacaggcatgcaccaccacacccagctaatttttttgcatttttagtggagacggagtttcgccatgttggtcaggctggtctcaaactcctaaccgcaaatgatctactcaccttggcctccgaaagtactgagattataggcgtaagccaccccgcccggcctggttctttcaatatatgaatacagcaagtcatttattttagctttatagaggtgtggtctctctgagtcataatcattaaaattcacattcccctaccatagcttcttccagagtatatgaaaactgaagataggtttgcagctcctaatgtgtatttgggtcctgctcaattt

SEQ ID NO: 331889 - DNA, 223 bp, Homo sapiens
tgcctgtaccttcccaccgaccctggttgtgacaaccaatggagtctccagatattgccacatatcccccgggggacaaaatcacccccaggtgagcatcgctgctctaaactgacgcctattgccatggcagctgtgtacatcaatgtcacaggtttgggagctcttgaccatgcagctgaacctttgctgctactctgaagcactaacaggaggtcaagct

SEQ ID NO: 331890 - DNA, 612 bp, Homo sapiens
ggatggggctgccaatggggctgtgggctgggtcttctgaaggagacctcagaggagagacacgagtaggaagggcgaggagacggggcaatctggatcccacatcagtgtccacctcagggcagggctcgatcctgttatctgtaaccagctcaacaaagcaaatactcagaaatgagcatgggagctgagagcaggagacctgtgaggaggtggctgtgggcattcacagagggcagcaggatgccaggcatggcagagcacccagcatgcaaagacgcggctgggctggggactaggtagtgcccaggccggccccgtccctctgagcaggaactctggcagcagctccgcaaacgtggagcagggggacattctccccgccagcccccaggatctccatctcagagggccacaaaggggagcagctatgcccagtctgaggggcagctgaacatctaaaccagccagcaggacattcagctgacagagggtctcgagaccgggctgggaagtctgaccacatcctgggggaccaagaggcgctgaggattctggagcacaggagtggggtggctggtatggccctgtagtcagagccgggtaggactg

SEQ ID NO: 331891 - DNA, 299 bp, Homo sapiens
gtgttctgatgggagctggagctgagagccctgggggccttccaaggaagcctgggctctgagaagtaatgtgaaagtcactaggccaatcaatccttttgtttaacagagcccctaactgaagcccagagagaaataactcaccaaacagcagacagagtctcaaaggaccaggactccagcagagctagggcctgtgactcctagtttgaactccgtattagttaagcgaatctggccctgaaagtaatcctgaactctgaactgcaaccatctacttgagagtccatgtgctctcc

SEQ ID NO: 331892 - DNA, 1691 bp, Homo sapiens
tgcttgacaaagaacttcccaatcctcctccgagccctccagtccctagcccagttcgcccgggcccgcccctagcaacaagatcgcggggaggggccgaggcgaaacacgagccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaagggg

SEQ ID NO: 331893 - DNA, 462 bp, Homo sapiens
cggacgcgtgggtcgacccacgcgtccggcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331894 - DNA, 1124 bp, Homo sapiens
cggacgcgtgggtcgacccacgcgtccggggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggatttgaacaacaaaacaaaacaaaacaaaaaacaaacaaaaaaacaaaaaaaacaaaagacaaaaaacaaacaaaacaacaaacaaacaaacaacgaaccacgaaaaacaacaaacaacgaaacaaaaagaacaacaaaaaaaacacaacgacaaaaaacacacggggggccgccgacttaactccattaactgactacgcaggaggaaacccaaccgcgtaggtaccatccacagacgcagtcatacacgaaagggacgcaccataagggaaagaagagagaaaaacaaacaagaaaagcggtcggcccatattaaccaaaagatgagccagcagccaaagatcacgagtcatcccataagcaggcagacgcacaactgctgggtgtctgacatcaaagacacacaaaccagaaaatagcgcgcgagaacaaactcacggctataaaggac

SEQ ID NO: 331895 - DNA, 2465 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331896 - DNA, 2742 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgacaaggaaacttcaggctcagtcactgaactaagtcaaaagccgggatttatcttttggcttctaaactcagttctttctactccaccacatggccttcatcatgaataaattactgcatcattatccccaagaaactgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331897 - DNA, 2620 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgacaaggaaacttcaggctcagtcactgaactaagtcaaaagccgggatttatcttttggcttctaaactcagttctttctactccaccacatggccttcatcatgaataaattactgcatcattatccccaagaaactgcctaccagctgtttgacggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331898 - DNA, 2757 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggatttaaaaaggaaaacattatgacgaacagaacaaaacacacttgtggttggccggacagcgggccaccgaagaaagtttactaaacccaatgctgttgggggcgcgggcgcccaagaagggagggcgaacacgtgccacagcgggtccaaagaaaacccgggcaagacaaaggggggttggtcccccccaaataaaacacccgggggcagcaggcgtttgaaacaaccccagagggcctcagagcacaccgtcgctacaaagagccacgaaccagaataccgcgggggaggcggc

SEQ ID NO: 331899 - DNA, 2783 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattttaaaaaaaaaaaaaaaatgtatacaccagatcatatatattcctatgcatgaaataaactatagactacaacgaaatgactatacctacatgatctaatgaaataacaaaaagcgggcgccttatactacttcgtcgagcctatcaaccactctttataaggcgccatatagattaacgaggcgcgcgttacatcgaatgaaacggtgatactaccaccttctgtgtctgacccacaattccgtaatttgttgtccctgtgtgggttgttaataacaaatttacttacttgtcataatcatcgagcactactctcacc

SEQ ID NO: 331900 - DNA, 2552 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggatttaaaaaaaaaacattttcccatcctacccatttttaggcgtacggtccagtgactttaagcactttcactctgtacggggattcctct

SEQ ID NO: 331901 - DNA, 2058 bp, Homo sapiens
ggttagatctagaggtcccctctctctgtgggtgtgatgctctctcgtggggtgacgctctctctgtggggtgacgctctctctgtggggtgacgctctctctgtgggggacgctctctctgtggggggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331902 - DNA, 1945 bp, Homo sapiens
gagatgatgacagaaaggctggaaggaagggggtgggtttgaagaattccgggatctgaacaaggacgggaagttagacaaagatgagactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331903 - DNA, 1870 bp, Homo sapiens
ccaatctagaggacccactaacctaatcgctcctcaccccgtgactgagagcaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331904 - DNA, 1649 bp, Homo sapiens
ggactctagatgatcccgctgcgcctactactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331905 - DNA, 1653 bp, Homo sapiens
tgttttaccttttgcttcctaggaaaccctggaggacatcgacaagaacggggatgggtttgtggatcaggatgagtatattgacaaggaaacttcaggctcagtcactgaactaagtcaaaagccgggatttatcttttggcttctaaactcagttctttctactccaccacatggccttcatcatgaataaattactgcatcattatccccaagaaactgcctaccagctgtttgagttaggtctctggattggttgtcgcctttcctaaagctcaggagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331906 - DNA, 1937 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagtttaactccaagccgtaggacccactttcctttcttagctgatgtcattggccatgtacgccgtgtgctgtacgtgctatgagttgtagcgttggcattacgtctctgtatacacgaccgc

SEQ ID NO: 331907 - DNA, 1229 bp, Homo sapiens
caatcactgctcatgactgagaacaagcttttagtatatgaatcatatcaaaaacaaagatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331908 - DNA, 1747 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtgctgccgccactactacatataaggaaacagcctcagagaggttaagaaatgtgcctagggtcacagttaaaaagtgacaagaggccaggcacagtggctcaagcctgtaatcccagcactttgggaggccaaggcaggtggattgcttgaggtcagaagtttgagaccagcatggccaacatggtgaagacctgtctctactaaaactaaaaaaatttagctgggtgtggtggcacatgcctatagtcctagctactcaagaggctgacgtgg

SEQ ID NO: 331909 - DNA, 1419 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgccaggtatacatcatcttattctcttcttgatttgtcagtactttttagggaccattagttctctgcctactatgtgccagactctaccctaagcatttagaattccagttaacaataggtaaatcttctattcatttaaaatttcattctaacagctagtaatgtatttggaggaataaatgccgtgaagaaaagcagaccgagtgttatctataggtagttatgggagatgtatgttatcttatattggttgatcaggcagacacaaactgataaaggggcgattgcttatttctctgaaagaagcaggaaatgagaaccact

SEQ ID NO: 331910 - DNA, 1451 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgtactgtaagtggtgtatatgaaacctccatgcattttccagtatggatctgctaatatgcacagtaaatccatgtctttgtttgtttttctattaaaaagggaggactgtgggtattaggtgtccaagaagaaagctcaaatctgctgacggcaggtaccttgcttgggatttactggaggactgtgggtattaggtgtccaagaagaaagctcaaatctgccaacggcaggtaccttacttgggatttactctccgacgggtcgatgccacccgggaacagaaagaaagcaggtcatttgcaatctaccggagcctggaggactgtgggtattaggtgtccaagaagaaagctcaaatctgccaacggcaggtaccttacttgggatttactctccgacgggtccgatgccgcccgg

SEQ ID NO: 331911 - DNA, 1677 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgtactgtaagtggtgtatatgaaacctccatgcattttccagtatggatctgctaatatgcacagtaaatccatgtctttgtttgtttttctattaaaaagttcggatttactctccgacaggggtccgaacgcagcccgggaacagaaagaaagcaggtcatttgcaatctaccggagcctggaggactgtgggtattaggtctccaagaagaaagctccaatctgccgacggcaggtaccttacttgggagttactatccgacaggggtccgaacgcagcccgggaacagaaagaaagcaggtcatttgcaatctaccggagcctggaggactgtgggtattaggtgtccaagaagaaagctcaaatctgctgacggcaggtaccttgcttgggatttactggaggactgtgggtattaggtgtccaagaagaaagctcaaatctgccaacggcaggtaccttacttgggatttactctccgacgggtcgatgccacccgggaacagaaagaaagcaggtcatttgcaatctaccggagcctggaggactgtgggtattaggtgtccaagaagaaagctcaaatctgccaacggcaggtaccttacttgggatttactctccgacgggtccgatgccgcccgg

SEQ ID NO: 331912 - DNA, 626 bp, Homo sapiens
atacaatggtggtagcagggccaggaaggaaggaatactacagatttattgtttaatggataaagagtttctgtttgcgggtaggcgtcctggctcacacctgcaatccctatacttggggagcctgaggggagaggatcgcttgagcccaggagctgaggcctagacgacagaataagaccctgtctcttaacaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331913 - DNA, 489 bp, Homo sapiens
ttttcacattatctttcttgattgctttttaatagaaaaacaaacaaagacatggacaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331914 - DNA, 1319 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctactgtaagtggtgtatatgaaacctccatgcattttccagtatggatctgctaatatgcacagtaaatccatgtctttgtttgtttttctattaaaaagttcggatttactctccgacaggggtccgaacgcagcccgggaacagaaagaaagcaggtcatttgcaatctaccggagcctggaggactgtgggtattaggtctccaagaagaaagctccaatctgccgacggcaggtaccttacttgggagttactatccgacaggggtccgaacgcagcccgggaacagaaagaaagcaggtcatttgcaatctaccggagcctaagggcagaaggcaggtgagggaattctcaggggctgtggggttttatagactgtgcatcccaaactttgcagtgttagccaagcctttgtatgaggtcacaaagggggcggggaccgggaacctttggaatggggatcccaagaacagaaagtctttcaggagttaaaggaaaaacttctggcagccccagccctggggctacccgatctggcaaaggcttttccattgtatgcgttagagagagaaaagatggcagctcgacccgct

SEQ ID NO: 331915 - DNA, 1417 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaaccgaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgtactgtaagtggtgtatatgaaacctccatgcattttccagtatggatctgctaatatgcacagtaaatccatgtctttgtttgtttttctattaaaaagggaggactgtgggtattaggtctccaagaagaaagctccaatctgccgacggcaggtaccttacttgggagttactatccgacaggggtccgaacgcagcccgggaacagaaagaaagcaggtcatttgcaatctaccggagcctaagggcagaaggcaggtgagggaattctcaggggctgtggggttttatagactgtgcatcccaaactttgcagtgttagccaagcctttgtatgaggtcacaaagggggcggggaccgggaacctttggaatggggatcccaagaacagaaagtctttcaggagttaaaggaaaaacttctggcagccccagccctggggctacccgatctggcaaaggcttttccattgtatgcgttagagagagaaaagatggcagctcgacccgct

SEQ ID NO: 331916 - DNA, 1172 bp, Homo sapiens
  misc_feature (1028)..(1028): n is a, c, g, or t
  misc_feature (1041)..(1041): n is a, c, g, or t
  misc_feature (1049)..(1049): n is a, c, g, or t
  misc_feature (1090)..(1090): n is a, c, g, or t
  misc_feature (1112)..(1112): n is a, c, g, or t
  misc_feature (1132)..(1132): n is a, c, g, or t
tgcttgacaaagaacttcccaatcctcctccgagccctccagtccctagcccagttcgcccgggcccgcccctagcaacaagatcgcggggaggggccgaggcgaaacacgagccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgnaaacccttggganggacatcnacaagaaacgggggaatgggttttgttggattaagggaatngagtttaattggccgggataangttttcccaatggaaggaanaattgggcccttgaagcccaaaactgggggttttaatcaa

SEQ ID NO: 331917 - DNA, 2459 bp, Homo sapiens
tgcttgacaaagaacttcccaatcctcctccgagccctccagtccctagcccagttcgcccgggcccgcccctagcaacaagatcgcggggaggggccgaggcgaaacacgagccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331918 - DNA, 2692 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggatttaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatatacttaatgcctttacttttctaggtcattttaactataaaatc

SEQ ID NO: 331919 - DNA, 2913 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggatttgaacaacaaaacaaaacaaaacaaaaaacaaacaaaaaaacaaaaaaaacaaaagacaaaaaacaaacaaaacaacaaacaaacaaacaacgaaccacgaaaaacaacaaacaacgaaacaaaaagaacaacaaaaaaaacacaacgacaaaaaacacacggggggccgccgacttaactccattaactgactacgcaggaggaaacccaaccgcgtaggtaccatccacagacgcagtcatacacgaaagggacgcaccataagggaaagaagagagaaaaacaaacaagaaaagcggtcggcccatattaaccaaaagatgagccagcagccaaagatcacgagtcatcccataagcaggcagacgcacaactgctgggtgtctgacatcaaagacacacaaaccagaaaatagcgcgcgagaacaaactcacggctataaaggac

SEQ ID NO: 331920 - DNA, 2820 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattttaagcgtacagttcagtgacattaagcacattcacattgctgtgtaaccatcgccaccatccatctccagaacttgaaataaatggttttgagtagattttggtttttaattgatttagcattgtatgtccttgtagccctggtacaggcccaagctggaaaataagagccccaacttccatctgaatacttggatttttcatgcttgtgagaggctcccatagttccctgaattcatctagaaatagcaactatcgtgtcaagcaaatatttttcattcaaccagcctactccctgggcttcaaatcctttcatatgaggaacaaagccaaacaccagcagttggtgattgctg

SEQ ID NO: 331921 - DNA, 2027 bp, Homo sapiens
tatccttgtggctgttgcataggctctgttacttgggccattgatactacacatcacatgtaaatatctctacaaacgcagggggcaggggaagtccgaactgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331922 - DNA, 2335 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaaccgaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331923 - DNA, 2425 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctagctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331924 - DNA, 1867 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttgtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331925 - DNA, 1436 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaaccgaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgtactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331926 - DNA, 1178 bp, Homo sapiens
  misc_feature (1034)..(1034): n is a, c, g, or t
  misc_feature (1047)..(1047): n is a, c, g, or t
  misc_feature (1055)..(1055): n is a, c, g, or t
  misc_feature (1096)..(1096): n is a, c, g, or t
  misc_feature (1118)..(1118): n is a, c, g, or t
  misc_feature (1138)..(1138): n is a, c, g, or t
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgnaaacccttggganggacatcnacaagaaacgggggaatgggttttgttggattaagggaatngagtttaattggccgggataangttttcccaatggaaggaanaattgggcccttgaagcccaaaactgggggttttaatcaa

SEQ ID NO: 331927 - DNA, 1547 bp, Homo sapiens
ttttttttttttgagacagggtcctgctctgtcgcctaggctggagtgcaatggtgcatggtcatggcttgagcctggttaatttttgtatttttactagaaacagggttttgtcatgttgcccaggctgatctcaaacacctggattcaagcaatccgcccatcttgacctcccaaagtgttgggattacagatgtgagccaccgcgcttggccacgattccgtgatggtcaaagaaatcaaaacgtctgtcagctagtgttcagttcaggctgaggtgaaaaaatttttttacttgtaaaatatacataacataaaacttggccgccgcgctccgagcccccattcccgagctgccgctgttgtcgctcgctcagcgtctccctcccggccgccctctcctcgggacgatggcgcgcggtgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaaccgaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttgtactgtaagtggtgtatatgaaacctccatgcattttccagtatggatctgctaatatgcacagtaaatccatgtctttgtttgtttttctattaaaaagttcggatttactctccgacaggggtccgaacgcagcccgggaacagaaagaaagcaggtcatttgcaatctaccggagcctggaggactgtgggtattaggtctccaagaagaaagctccaatctgccgacggcaggtaccttacttgggagttactatccgacaggggtccgaacgcagcccgggaacagaaagaaagcaggtcatttgcaatctaccggagcctggaggactgtgggtattaggtgtccaagaagaaagctcaaatctgctgacggcaggtaccttgcttgggatttactggaggactgtgggtattaggtgtccaagaagaaagctcaaatctgccaacggcaggtaccttacttgggatttactctccgacgggtcgatgccacccgggaacagaaagaaagcaggtcatttgcaatctaccggagcctggaggactgtgggtattaggtgtccaagaagaaagctcaaatctgccaacggcaggtaccttacttgggatttactctccgacgggtccgatgccgcccgg

SEQ ID NO: 331928 - DNA, 752 bp, Homo sapiens
tgagagagtgtatgggttcgtcaaggacgtcgagagtcccaggagtcgatgggagcgtcactgccgcgcagagacaaggaaatggctggcagcgtgggcaccattgagagggtacgcgacagcctggtcatagggcctaggagacactggaaggggtagagctgtgaaggagccatgcagagagccgtatccggcagcaggggtgagttaggtggggaagagttgccagaaagaccacgcatgccatgtataatgatccagcagctaggtgtgaggtaggggcctggtaggcataccaggccaggctaaggcactgacgcacactcagaggggtctgtagcttgcatgagaccccacctgcagagttgccacacattgtaccttatgatatggcaggcgtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattt

SEQ ID NO: 331929 - DNA, 3409 bp, Homo sapiens
agtatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaatgttcacaaaatga

SEQ ID NO: 331930 - DNA, 1556 bp, Homo sapiens
agtatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaatgttcacaaaatga

SEQ ID NO: 331931 - DNA, 1325 bp, Homo sapiens
agtatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggtttgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaatgttcacaaaatga

SEQ ID NO: 331932 - DNA, 299 bp, Homo sapiens
tgtccacctgttccctacactgcccgtcccactgtgggtctaacctctgcctctctccctccctggccccgctccccgctccccgcttccctttcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaa

SEQ ID NO: 331933 - DNA, 2755 bp, Homo sapiens
agtatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaatgttcacaaaatga

SEQ ID NO: 331934 - DNA, 3208 bp, Homo sapiens
agatgataagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaagccatccagcccaagctgggcagatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaagtcccatggtttcctatttttcaatcttgatatgtatttatttttcacttgtctttgaaaatttcacgcatttagtgtttgcagcaagactgaaaatttagataatttttctatagaggtagatgactgaaaggtgaatggaaacttcttttctcatgtcacacatctttggggattctgaaaagatatgtttggaaataaggaatttgaaagattcacatcttagctaacctccttcttgtgccggaagtgctacggaggccttgggaaattcagtgggttttccaagatctgatttgttggtgacggaagtgagatcaaggccgcttccagatttcaagtccagggctctacctactataatctacgctcacaaaatctcagacaagagatcggaacttcaggtttctcggaggttgaagtcctctggatctttgctgcctttatgacatcagtgccctgatggcagagttcctggttcgtctccctggtaattgagttcataatacctagaccttcctctgacttttttacttaaatttgttcttattttcaatattgaacaagccagcctttaacatgactctaccagcttagacatataggcctagactttaatgaattaacctaatcacagtgctaccagagtcttgtttggacaacttagtgagccccagatgtctatgagcccaaagtcccaggtctgaaccatagacagaggcttagtccagagtgggtttttaaaaatgaataaaaccagcttcattaggtataattgatatacaaagaactgcacatatttaatggagggagttggatgagtttggatgtgttgcatatgcccttgattgccatctccaccatcaaagtaattaacaccttcattgcctccag

SEQ ID NO: 331935 - DNA, 3355 bp, Homo sapiens
agatgataagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgattaatacatcattcatcagacttcattcgtgatctcgaagagtgacatcagtcttccttggaatatgaagagaatttctttggttcttcttttgcatttctatttgatttattttattttattttattttatgttttttggtacagaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaagccatccagcccaagctgggcagatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaagtcccatggtttcctatttttcaatcttgatatgtatttatttttcacttgtctttgaaaatttcacgcatttagtgtttgcagcaagactgaaaatttagataatttttctatagaggtagatgactgaaaggtgaatggaaacttcttttctcatgtcacacatctttggggattctgaaaagatatgtttggaaataaggaatttgaaagattcacatcttagctaacctccttcttgtgccggaagtgctacggaggccttgggaaattcagtgggttttccaagatctgatttgttggtgacggaagtgagatcaaggccgcttccagatttcaagtccagggctctacctactataatctacgctcacaaaatctcagacaagagatcggaacttcaggtttctcggaggttgaagtcctctggatctttgctgcctttatgacatcagtgccctgatggcagagttcctggttcgtctccctggtaattgagttcataatacctagaccttcctctgacttttttacttaaatttgttcttattttcaatattgaacaagccagcctttaacatgactctaccagcttagacatataggcctagactttaatgaattaacctaatcacagtgctaccagagtcttgtttggacaacttagtgagccccagatgtctatgagcccaaagtcccaggtctgaaccatagacagaggcttagtccagagtgggtttttaaaaatgaataaaaccagcttcattaggtataattgatatacaaagaactgcacatatttaatggagggagttggatgagtttggatgtgttgcatatgcccttgattgccatctccaccatcaaagtaattaacaccttcattgcctccag

SEQ ID NO: 331936 - DNA, 3005 bp, Homo sapiens
agatgataagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaagccatccagcccaagctgggcagatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaagtcccatggtttcctatttttcaatcttgatatgtatttatttttcacttgtctttgaaaatttcacgcatttagtgtttgcagcaagactgaaaatttagataatttttctatagaggtagatgactgaaaggtgaatggaaacttcttttctcatgtcacacatctttggggattctgaaaagatatgtttggaaataaggaatttgaaagattcacatcttagctaacctccttcttgtgccggaagtgctacggaggccttgggaaattcagtgggttttccaagatctgatttgttggtgacggaagtgagatcaaggccgcttccagatttcaagtccagggctctacctactataatctacgctcacaaaatctcagacaagagatcggaacttcaggtttctcggaggttgaagtcctctggatctttgctgcctttatgacatcagtgccctgatggcagagttcctggttcgtctccctggtaattgagttcataatacctagaccttcctctgacttttttacttaaatttgttcttattttcaatattgaacaagccagcctttaacatgactctaccagcttagacatataggcctagactttaatgaattaacctaatcacagtgctaccagagtcttgtttggacaacttagtgagccccagatgtctatgagcccaaagtcccaggtctgaaccatagacagaggcttagtccagagtgggtttttaaaaatgaataaaaccagcttcattaggtataattgatatacaaagaactgcacatatttaatggagggagttggatgagtttggatgtgttgcatatgcccttgattgccatctccaccatcaaagtaattaacaccttcattgcctccag

SEQ ID NO: 331937 - DNA, 2673 bp, Homo sapiens
ctccgagcaggacactgctacttaacaaggtggtttgagccaagtatgtgtcttgcgggtccttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccttcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcataaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagagaaaccatataattgtaaagaatgtgggaagagcttcagatggtcctcatgccttttgaaccatcagcgagtccacagtggagaaaaaagcttcaaatgtgaagaatgtgggaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataactgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaaggggtcagtgtctcatccccacataacacaaaaagcagcctggggaagacaatcaagctacaggcactgataagggaactagcacaggggattgtgcctggagacatgcccatgcctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 331938 - DNA, 2929 bp, Homo sapiens
ctccgagcaggacactgctacttaacaaggtggtttgagccaagtatgtgtcttgcgggtccttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccttcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcataaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagagaaaccatataattgtaaagaatgtgggaagagcttcagatggtcctcatgccttttgaaccatcagcgagtccacagtggagaaaaaagcttcaaatgtgaagaatgtgggaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataactgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaaggggtcagtgtctcatccccacataacacaaaaagcagcctggggaagacaatcaagctacaggcactgataagggaactagcacaggggattgtgcctggagacatgcccatgcctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcattcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttcacccttgtgtctgtgcttcttaatcatattggacgtgagattaagaactccgggggataagagagactgttacagagagactgttacagtgtggtgcatttgtgagactacaacacatttttagcaatttgtaaataattgttgatgatagtcacctttagtgctgcagaacagtagaacttattcttcccctctacctcttttgtatctgttggccaacctttggccatctcacctacctcctacacttccttgcctgtctacatccactgttctactctctactacaaaatcaactttttttaacttc

SEQ ID NO: 331939 - DNA, 2619 bp, Homo sapiens
ctccgagcaggacactgctacttaacaaggtggtttgagccaagtatgtgtcttgcgggtccttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttggacagaaaccttcccagggtgggaagtgtaaacagtccttcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcataaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagagaaaccatataattgtaaagaatgtgggaagagcttcagatggtcctcatgccttttgaaccatcagcgagtccacagtggagaaaaaagcttcaaatgtgaagaatgtgggaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataactgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaaggggtcagtgtctcatccccacataacacaaaaagcagcctggggaagacaatcaagctacaggcactgataagggaactagcacaggggattgtgcctggagacatgcccatgcctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 331940 - DNA, 2596 bp, Homo sapiens
ctccgagcaggacactgctacttaacaaggtggtttgagccaaactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccttcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcataaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagagaaaccatataattgtaaagaatgtgggaagagcttcagatggtcctcatgccttttgaaccatcagcgagtccacagtggagaaaaaagcttcaaatgtgaagaatgtgggaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataactgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaaggggtcagtgtctcatccccacataacacaaaaagcagcctggggaagacaatcaagctacaggcactgataagggaactagcacaggggattgtgcctggagacatgcccatgcctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 331941 - DNA, 2983 bp, Homo sapiens
ctccgagcaggacactgctacttaacaaggtggtttgagccaagtatgtgtcttgcgggtccttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccttcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcataaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagagaaaccatataattgtaaagaatgtgggaagagcttcagatggtcctcatgccttttgaaccatcagcgagtccacagtggagaaaaaagcttcaaatgtgaagaatgtgggaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataactgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaaggggtcagtgtctcatccccacataacacaaaaagcagcctggggaagacaatcaagctacaggcactgataagggaactagcacaggggattgtgcctggagacatgcccatgcctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttcacccttgtgtctgtgcttcttaatcatattggacgtgagattaagaactccgggggataagagagactgttacagagagactgttacagtgtggtgcatttgtgagactacaacacatttttagcaatttgtaaataattgttgatgatagtcacctttagtgctgcagaacagtagaacttattcttcccctctacctcttttgtatctgttggccaacctttggccatctcacctacctcctacacttccttgcctgtctacatccactgttctactctctactacaaaatcaactttttttaacttc

SEQ ID NO: 331942 - DNA, 324 bp, Homo sapiens
ataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttctttgtttacttggc

SEQ ID NO: 331943 - DNA, 236 bp, Homo sapiens
gctgaaagagaaaatgcagatttaattatttgccatagggagcattcctttgttaccaatcaaaggactggaaagttgaaaatttctgtttcaatgaaaaagcatggattatttttttttagcatggaaattttataaggtaggaattttttttttttccaagacagggtctaactctgctgcccaggctggagtgcagtggcatgatcttgacttactgcaacctctacctccca

SEQ ID NO: 331944 - DNA, 240 bp, Homo sapiens
gcaccagtcatgtgtggagtgggttggtggagatgcgcagagtgcaaggaggtctggaggtgagacctccaggcagaatggagggaggtgtgtcccatagcatgtggactctaaggggctgggagatcttaggggtccctggaggctgactgaaggctggccagggagcctgcctggtaagggcctccaaggtcaggtttgggtgtaagagtagccatttctagcactggttgaggtgca

SEQ ID NO: 331945 - DNA, 585 bp, Homo sapiens
agttggtcccgttcagaaagtaggtgtctttaaaacctaactgagcaacacagaattcatcctatatctatcccattcaaaaaaattataaatccaactttcccactactgagacaaaagtcttaaggtgatcttgagctttgatctctcaattatcaactaggggctgggggaagaattagatgttttctctggctaataccattactattctacaaataaatcctagacatttaatgtatgttaatgagataatctgttagtacttaacacagagtataaatgttcaagaaatgttagttctgtcccctcatcacaagaaatgcttataatacagagaaatctgaagtctctctgtagctatactgaaaattccttaggctcaattcataagcactttgaaggccaggctcattggctcacacctataatcccagtgctttgggaggccaaggcaggaggactgcttgagtccaggagtttgagaccagcctgagcaacatagtgagacccctgtctctacaatatttttaaaattagctgggcatggtggcatctacctgtaattctagctcctcaagaggc

SEQ ID NO: 331946 - DNA, 401 bp, Homo sapiens
aaagaaataaagtatattctgtctagaggagacaatattcatagctatcccctattagacatcaatctaattttaggacatttccattatcctaaaaagaaacctcatgtccttttacagttatccccattgcctgccctaggcaccaccaaactttctgtctttatatatttgcctttcttagacatttaatataataaacataatgctttaaaggatcatccatgttgttaactcgtgtcttttaaaaccaacatacatggtggttctgactggtatctcctaatgatctcatttgaaagtcaaggcaaaatttctgccatgtacaaagttaaataaagccaatttaaagaatttatagaatcagttacacaaaactaaaatggatgggtaccgagcta

SEQ ID NO: 331947 - DNA, 500 bp, Homo sapiens
cttttccactaggatggcttgcattatggctctcccttggttaaaaaaaaaaaaaaaaaaagagaaaagaaatggagggtttagcaggttactttgggctgcagccagagtgattgccacatgcatttctctctttatctcctctctctcctaccataggctcagttctgtatcagaaagggctgaggttcctacatgcaccaccttccttcaaaggggcaggtacgtcaggtcacatacactcaagtgttttgaaagaatccatttccccactgactttctgataggctgcttctgggtcaagttctgtagccaatactttttttagtctgttttccccgtgaggaaaacatccagtcagaatggcagtctcaaggacaagtggggaactgtggtggagacgatttgcttacttccatcttggaggccaagggtgtaacttggctacctcagtagctccttggtggtgcttactcagtgcccctgggtaggaaaatcaa

SEQ ID NO: 331948 - DNA, 684 bp, Homo sapiens
tgagtctttgaagcttcaaggctgctgaataatttccttctcccattttgtgcctgcctagctatccagacagagcagctaccctcagctctagctgatactacagacagtacaacaggtgtggtacatgtggctttgctcactcatgtggatagcatggatttgattacaaaaggtgaccttatagaaatagagagatgtgagcctgtgaggtccaaggtaatgaatgatgcccttcgtaaacacattttctggggtatgttactacaatcacatactagtgtgtataaaaataaaaacaagcagctactgggtttaagaagaattacaaaattacttaaatagggcccgtttcccaagatttaaaaattaaatacagttgttccttggtatttgcaggggattagttccaggactttgcattgttaccaaaatctgtggatgcttaatggcatagtatttgtatttgcatataacctatgcacatcctttggtatactttaaataatatctagattacttataatacctaacccaaattaaatgctttgtaaatagttgttctactctatttttcattattaatgacaagaaaataacctgtacatgttcagtacagatgaaatattttttcaaaatttatttttttgagatgaagtttctgttgcccaggctggagtgcag

SEQ ID NO: 331949 - DNA, 1276 bp, Homo sapiens
tgagtctttgaagcttcaaggctgctgaataatttccttctcccattttgtgcctgcctagctatccagacagagcagctaccctcagctctagctgatactacagacagtacaacagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331950 - DNA, 1695 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331951 - DNA, 2629 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaataggtagatggtttggtggtgtggaagcttggaagcggtcaggtagttggctactttctgcttggatctattaaatacctggcagctctctgtctttttgtgggttgttgccctgtgattagttctgctttttaacccactccctggatgcatttttccctccttgcatttccctcttttcctggagttcatactagagaatctgcactatgtttttccctttttgtcttgagatgaaagttttaaaataatccacctctgtcatttccactctctgaacatcccaagctgtatccctggcctcttttctcagactatgtttctttacttgggacctagaactggattggattggcattgctcctgatcagatgagacctttgattatttgccccttccttaggaccttacactcctgtctttctttgacttgcctttttgtttctttccttcatcttagtccctcttcatgcagtatggtcattgctaggtagaggtatgtccttttatgtaatggccaccgcatttagtattacataaactttcttttaacaatctgtgcatagtacatgctgctctgttccatttagagatttgacagaggtttcagtttagtatactcaaatcttattttagtgcttgggaaatcaattcagaatatcacatcctctccaattctctcttactcaaattgctgggaaactctcatgttactaactttgttgctctaactctgccatcttggtttccccatcccttctcttcctcatggtacgtgtgctcctaatattagcgttggttgagattttcagtggtccaatattcctcttccctctggttgcctttcctgagataatccactaagaatattttgtgtttcttttctcagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331952 - DNA, 1217 bp, Homo sapiens
tgagtctttgaagcttcaaggctgctgaataatttccttctcccattttgtgcctgcctagctatccagacagagcagctaccctcagctctagctgatactacagacagtacaacaggccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331953 - DNA, 1642 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctgctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331954 - DNA, 802 bp, Homo sapiens
ggcgtctagagcgatgcttatacaccctttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331955 - DNA, 1608 bp, Homo sapiens
tttagaatccactgcatgtattccaaattacaattatcagtgacattagaacttgatatgtgaagttcttcaagagtactttgtgagaccagatctccatttttttccaatgggaaattattgcaagttcctacatcttgatattgctttcataatttatactaacataaaataatatttttcactgttttgcaatgtctttttaatttctgtattgcagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaataggtagatggtttggtggtgtggaagcttggaagcggtcaggtagttggctactttctgcttggatctattaaatacctggcagctctctgtctttttgtgggttgttgccctgtgattagttctgctttttaacccactccctggatgcatttttccctccttgcatttccctcttttcctggagttcatactagagaatctgcactatgtttttccctttttgtcttgagatgaaagttttaaaataatccacctctgtcatttccactctctgaacatcccaagctgtatccctggcctcttttctcagactatgtttctttacttgggacctagaactggattggattggcattgctcctgatcagatgagacctttgattatttgccccttccttaggaccttacactcctgtctttctttgacttgcctttttgtttctttccttcatcttagtccctcttcatgcagtatggtcattgctaggtagaggtatgtccttttatgtaatggccaccgcatttagtattacataaactttcttttaacaatctgtgcatagtacatgctgctctgttccatttagagatttgacagaggtttcagtttagtatactcaaatcttattttagtgcttgggaaatcaattcagaatatcacatcctctccaattctctcttactcaaattgctgggaaactctcatgttactaactttgttgctctaactctgccatcttggtttccccatcccttctcttcctcatggtacgtgtgctcctaatattagcgttggttgagattttcagtggtccaatattcctcttccctctggttgcctttcctgagataatccactaagaatattttgtgtttcttttctcagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331956 - DNA, 1967 bp, Homo sapiens
acgcgtccgcggacgcgtgggtaaatgtttattgatattatctttaaggttgagccagtgtgttactctcttatcagctacacagatcatgaaaaaaattcccccgcactaaaaattttacaattttataaatagtggtgaggggatgggagtgtgggataagaaaaagttgacaagagattatgtacgattgagtgtgataaatataatgaaacaatgaaaaataaagtgctttaaaagtttagagaaggaaagtatagtgttaaaggggttcggggagatttcatcaatggaacggcacagggaaacggctttcaaggagaagaaatatttcacaaaatgaagagacaaaaagggccaacaaattcagcatatgacaatatattaatggaggaaaagtcagcatgtttgggaaatgtggagttcaggttagtgaagggctggatctttgtaggcagagataaaatgggcaaggaacatttgcatgaagtaattttatttaattaggagcattatgaggaatcacagcaattttttgaaagagtaatgatatgatcaaatttaatttctgtattgcagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaataggtagatggtttggtggtgtggaagcttggaagcggtcaggtagttggctactttctgcttggatctattaaatacctggcagctctctgtctttttgtgggttgttgccctgtgattagttctgctttttaacccactccctggatgcatttttccctccttgcatttccctcttttcctggagttcatactagagaatctgcactatgtttttccctttttgtcttgagatgaaagttttaaaataatccacctctgtcatttccactctctgaacatcccaagctgtatccctggcctcttttctcagactatgtttctttacttgggacctagaactggattggattggcattgctcctgatcagatgagacctttgattatttgccccttccttaggaccttacactcctgtctttctttgacttgcctttttgtttctttccttcatcttagtccctcttcatgcagtatggtcattgctaggtagaggtatgtccttttatgtaatggccaccgcatttagtattacataaactttcttttaacaatctgtgcatagtacatgctgctctgttccatttagagatttgacagaggtttcagtttagtatactcaaatcttattttagtgcttgggaaatcaattcagaatatcacatcctctccaattctctcttactcaaattgctgggaaactctcatgttactaactttgttgctctaactctgccatcttggtttccccatcccttctcttcctcatggtacgtgtgctcctaatattagcgttggttgagattttcagtggtccaatattcctcttccctctggttgcctttcctgagataatccactaagaatattttgtgtttcttttctcagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331957 - DNA, 1568 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331958 - DNA, 1101 bp, Homo sapiens
tgagtctttgaagcttcaaggctgctgaataatttccttctcccattttgtgcctgcctagctatccagacagagcagctaccctcagctctagctgatactacagacagtacaacagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331959 - DNA, 1000 bp, Homo sapiens
tgagtctttgaagcttcaaggctgctgaataatttccttctcccattttgtgcctgcctagctatccagacagagcagctaccctcagctctagctgatactacagacagtacaacagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctgggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331960 - DNA, 851 bp, Homo sapiens
acgcgtccgcggacgcgtgggtaaatgtttattgatattatctttaaggttgagccagtgtgttactctcttatcagctacacagatcatgaaaaaaattcccccgcactaaaaattttacaattttataaatagtggtgaggggatgggagtgtgggataagaaaaagttgacaagagattatgtacgattgagtgtgataaatataatgaaacaatgaaaaataaagtgctttaaaagtttagagaaggaaagtatagtgttaaaggggttcggggagatttcatcaatggaacggcacagggaaacggctttcaaggagaagaaatatttcacaaaatgaagagacaaaaagggccaacaaattcagcatatgacaatatattaatggaggaaaagtcagcatgtttgggaaatgtggagttcaggttagtgaagggctggatctttgtaggcagagataaaatgggcaaggaacatttgcatgaagtaattttatttaattaggagcattatgaggaatcacagcaattttttgaaagagtaatgatatgatcaaagttaattaaagttatgatcttcagaaaaattaatctggcactgtgtacagaatagattggaatcaaaaggaacctggaggtgggaacaccagttgggagaatgcaatgatagcaagtatttgttgagcactaagtatgtgatagattttcttaatcagtccttataacaagcctatgaaatgggtactatcattactgcattttacaagtgaggaaacaaagaaaacagagtaaacatctgccaacgtttattgacagtgctgagcagtgacagataaatatttcgaacct

SEQ ID NO: 331961 - DNA, 797 bp, Homo sapiens
acgcgtccgcggacgcgtgggtaaatgtttattgatattatctttaaggttgagccagtgtgttactctcttatcagctacacagatcatgaaaaaaattcccccgcactaaaaattttacaattttataaatagtggtgaggggatgggagtgtgggataagaaaaagttgacaagagattatgtacgattgagtgtgataaatataatgaaacaatgaaaaataaagtgctttaaaagtttagagaaggaaagtatagtgttaaaggggttcggggagatttcatcaatggaacggcacagggaaacggctttcaaggagaagaaatatttcacaaaatgaagagacaaaaagggccaacaaattcagcatatgacaatatattaatggaggaaaagtcagcatgtttgggaaatgtggagttcaggttagtgaagggctggatctttgtaggcagagataaaatgggcaaggaacatttgcatgaagtaattttatttaattaggagcattatgaggaatcacagcaattttttgaaagagtaatgatatgatcaaagttaattaaagttatgatcttcagaaaaattaatctggcactgtgtacagaatagattggaatatttgttgagcactaagtatgtgatagattttcttaatcagtccttataacaagcctatgaaatgggtactatcattactgcattttacaagtgaggaaacaaagaaaacagagtaaacatctgccaacgtttattgacagtgctgagcagtgacagataaatatttcgaacct

SEQ ID NO: 331962 - DNA, 797 bp, Homo sapiens
acgcgtccgcggacgcgtgggtaaatgtttattgatattatctttaaggttgagccagtgtgttactctcttatcagctacacagatcatgaaaaaaattcccccgcactaaaaattttacaattttataaatagtggtgaggggatgggagtgtgggataagaaaaagttgacaagagattatgtacgattgagtgtgataaatataatgaaacaatgaaaaataaagtgctttaaaagtttagagaaggaaagtatagtgttaaaggggttcggggagatttcatcaatggaacggcacagggaaacggctttcaaggagaagaaatatttcacaaaatgaagagacaaaaagggccaacaaattcagcatatgacaatatattaatggaggaaaagtcagcatgtttgggaaatgtggagttcaggttagtgaagggctggatctttgtaggcagagatgaggaatcacagcaattttttgaaagagtaatgatatgatcaaagttaattaaagttatgatcttcagaaaaattaatctggcactgtgtacagaatagattggaatcaaaaggaacctggaggtgggaacaccagttgggagaatgcaatgatagcaagtatttgttgagcactaagtatgtgatagattttcttaatcagtccttataacaagcctatgaaatgggtactatcattactgcattttacaagtgaggaaacaaagaaaacagagtaaacatctgccaacgtttattgacagtgctgagcagtgacagataaatatttcgaacct

SEQ ID NO: 331963 - DNA, 1743 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331964 - DNA, 1684 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaaggccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331965 - DNA, 1780 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaaggtaatgaatgatgcccttcgtaaacacattttctgggctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331966 - DNA, 1467 bp, Homo sapiens
tgagtctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctgggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggaaaaaaaatagagagtgt

SEQ ID NO: 331967 - DNA, 785 bp, Homo sapiens
gaccttccaccatgaatgcagcagcacgtgaggctttcaccagaagcagatgcttgggccatgcttcttgtgcagcctgcagaactacagagtcttgctgtgtcgccagccagagtgcaatggcacgatctcggttcaccacaacctccgtcccttgggttcaagcgattctcctgcctcagcctcctgagtagctgggactacaggtgctcaccacgcccagctaatttttgtatttttagtagagacggggtttcaccatgttggccagtatggtctcaatctcttgaccttgtgatccacccacctcagccctccaaagtgctgggattacaggcgtgagccaccgctccgggccaagactctaatctttctatagtgtttgcttaacctaattcatgataatttatttctgcgatttccatgtctttcttttttaattgctactttattttactgagggttttccctgcattttatctgagagaatacttgtggcctgtctttaagaaacagctttgaagtagatttaccaggtgacttaatggtaatccctgtcttaggaataatatgatgtatattgttaaaattaacagtatattcattttaacctcaaacctgggatagccgaaggactaaaatttctctttggagatatatacgtgtaaaacatagagcctagacagagacagacaaacttccttgctatcttcctgtgatgctgggcaatttaaaaatttaatcatctatcaaatgtgtagacttttgagggcccctgttctgct

SEQ ID NO: 331968 - DNA, 909 bp, Homo sapiens
gaccttccaccatgaatgcagcagcacgtgaggctttcaccagaagcagatgcttgggccatgcttcttgtgcagcctgcagaactagacagggtctcactcagtttcccaggctggagtgcagtggtgtcatcatagctcactggagcctcgaaatcctgggttcaagcaatcatcctgcctcagacgcctgagtagctgcagctacagacagagtcttgctgtgtcgccagccagagtgcaatggcacgatctcggttcaccacaacctccgtcccttgggttcaagcgattctcctgcctcagcctcctgagtagctgggactacaggtgctcaccacgcccagctaatttttgtatttttagtagagacggggtttcaccatgttggccagtatggtctcaatctcttgaccttgtgatccacccacctcagccctccaaagtgctgggattacaggcgtgagccaccgctccgggccaagactctaatctttctatagtgtttgcttaacctaattcatgataatttatttctgcgatttccatgtctttcttttttaattgctactttattttactgagggttttccctgcattttatctgagagaatacttgtggcctgtctttaagaaacagctttgaagtagatttaccaggtgacttaatggtaatccctgtcttaggaataatatgatgtatattgttaaaattaacagtatattcattttaacctcaaacctgggatagccgaaggactaaaatttctctttggagatatatacgtgtaaaacatagagcctagacagagacagacaaacttccttgctatcttcctgtgatgctgggcaatttaaaaatttaatcatctatcaaatgtgtagacttttgagggcccctgttctgct

SEQ ID NO: 331969 - DNA, 949 bp, Homo sapiens
tagagaccaaggtttccctgtgtgacccaggctggtctccaactcctgagctcaagcagtcctttcaccttggcttcctgaagtgctgggattacacgcatgagccaccaggtttggccttaaacaatgtattaaatgctacagcatttaatatttgtcatccctaggctgatacaaccagttggaaaaatgcaatggttaatccattggtgagagaacatctgaagtggcactttgctatcttctaaagacagagtcttgctgtgtcgccagccagagtgcaatggcacgatctcggttcaccacaacctccgtcccttgggttcaagcgattctcctgcctcagcctcctgagtagctgggactacaggtgctcaccacgcccagctaatttttgtatttttagtagagacggggtttcaccatgttggccagtatggtctcaatctcttgaccttgtgatccacccacctcagccctccaaagtgctgggattacaggcgtgagccaccgctccgggccaagactctaatctttctatagtgtttgcttaacctaattcatgataatttatttctgcgatttccatgtctttcttttttaattgctactttattttactgagggttttccctgcattttatctgagagaatacttgtggcctgtctttaagaaacagctttgaagtagatttaccaggtgacttaatggtaatccctgtcttaggaataatatgatgtatattgttaaaattaacagtatattcattttaacctcaaacctgggatagccgaaggactaaaatttctctttggagatatatacgtgtaaaacatagagcctagacagagacagacaaacttccttgctatcttcctgtgatgctgggcaatttaaaaatttaatcatctatcaaatgtgtagacttttgagggcccctgttctgct

SEQ ID NO: 331970 - DNA, 493 bp, Homo sapiens
gcagtgccagggtcatcaggatgatgcggacgcagtgtctgctggggctgcgcacgttcgtggccttcgccgccaagctctggagcttctccgcccttttgcggtggcagatctgcatggtaattcagcaccaaactgttcgatatgatatcatccccttatcttcttgtcctggaatcagctaggtgaagaggaagatcatggtgctggatccggatgagatacttattcactcccaccatgatggggtcctgaggctcacagtctggcctggaacgcctcctgacttcatcctcaaggtggtaatagacaaacatcctgtccgtttctttgtacattagaggccccatgtggatttctttttggaagtcgtgagcgagtggtgggagctggtagtgtttatagcaagcatggagatctatggctctgctgtggcagataaactggacaatagcagaagcattcttaagacgagatactacggacagcactg

SEQ ID NO: 331971 - DNA, 365 bp, Homo sapiens
gggagaaataagcagttgctattcaatgggtataaattcttcatttatgcaacataattcagttctagagacctgctgtggagcattatgccaatagttaatactgctgtattatatacttaaaatgtgttcaaaagtgttaagaggacagatctcatgttaagtgttcttaccacaataaagaaaaagggaatgaattattgatacatgcaacaacttggatatatctcaatgacattatgccaagtagaaaaaaaaagtcattctcaaaaggtcatggactgcataatttcagttacacaacacactctaattgacaaaattatagagatatagaaaagattgttgattgcaaggaaaaaggg

SEQ ID NO: 331972 - DNA, 395 bp, Homo sapiens
tttacttaaaatatattctgggggctgggcacggtggctcacacctgtaatcccagcactttgagaggccaaggtgggcggatcacttgaggtcaggtgttcaagaccagcctggccaacatggtgaaaccccgtctgtactaaaaatacaaaaattagccaggcgtggtggcgggtgcctgtaatcccagctactcaggaggctgacgtgggaggattgcttaaggccagcctaggcaacagcaagaccttgtccctaaaaaggaaaaaaaaaaaattacaaaaaaagagcagctcaagaaactataggaaacactttggttaacacaaatctgttctctgtgctgccttcaaactaatctataagaaataatgaagtccatgttagggaacac

SEQ ID NO: 331973 - DNA, 1932 bp, Homo sapiens
gaaggacagaacgtttacagcagttgtctacggctgcctctgtgttctgaagaccccatgcacccctcgtcccttctgggttgggcctggcagtcccgtaggctgtctttcccttgctttgcagatgccagccccagagtcccacctccaccgttgtaagtctttgaaatcctgtgtgtattctacattgacgggacatctcattttggactaaccacatttcaagtgctcagtattcacatatggatactgtgcaggacagcacacactaattggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331974 - DNA, 2530 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaaaaaaaaaaacaaaaaaaccaaaaaagaaaaaaaaaagaaaaaaaaaaaataaaaagacaaagaagaacaacagaaaaagaaaagcaaaaaaaaaagagggggggcgcgacacaaaaatcccccagaggggggccccataagcaggacacgcaccgattttctggcacaagggggggccacaacgagggcggttaaga

SEQ ID NO: 331975 - DNA, 2682 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggtgagtgcggcccggcggagggagcctgggcccgaaggcggggcggaaggccgtggccagcctggcaagctggtggccttgatcctcggcgtccgggcactttgggcggcgggaccttgcggtgaagaggtgtgtgcacgcgcaggggcgccctggagcgcacagctgtatgccttacggggactctgcctgtgcaacagccacaccccgggttggggatcctttgtgtttcttggcggaaccacgcccctttcttccacgaaacacccactccgctgtcttcagctggagaagcagctcctttttcctattcctgacctcggacagagttttgcagaacaggtgtcaggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331976 - DNA, 2149 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagagggggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331977 - DNA, 3296 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtactggaggtggggggtgggttttatctggctttgttctccaaagatccccagttgggagattgagtggggttcagacaggactgacaacaattttcctctcaccaagtgacctcagttctctgccaccactggccttggtggtggtgggccttggggtggaggcagaagggcacgtgggtcgtgttgacagttttgtattacctgtgtttttttctttaatagctatcatggcttgcttaggctgtatgcctgtttctgaggaatttatgaagcagttgtcctttggacaaatctataactttcttttcctagccaattatactcaaagaactaggggattatagagaggttaggcatattttgttgggtgtcaggagatgctgaacagagggcttgtatatctgtacattgctctttctccactgtgaggtccatcctgccttaatttgggttcctgcagcctcagggcattctagggctctcttagatcctgctggactgagtcccctctagaaaagaagcaggaacaggctaaccaacagcagactgttagaagttggtggagggcactgacaggagtaccagccagctgttcagctaggatcctgggtccccagagctgacagcctcataggaacagacttacagtaactcagtgttgagctggatgcatactaggtgccagtgcattcctttagtgggtgctgccctcccttcctgagttggggggcctgagtgagcacctctgtacagggcacccctctacagagggaggtagctggtatgtttgtcagtggagacttgcttctccacctgccacgaggcgggcatccatccggcagtagactcctagctcagggtgctcctgtgatggctgccttgcaacagagagaggatagcccaggaatggcagctccctcctttctcaccagtttccttcttccgtcctccctaccccaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331978 - DNA, 3063 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcaggtgagctcactgactggcccagctccaggtcctggatctgctccttccttcactccctgtctttctctccttagccttggctcactgagcccttggggcttcctggggacaactcctgaacctggccattccatgtgcaggatcatgactgagatcatagaggtgcaaatgctggacgagctgctgaccctgctctccagcagtgacttgcacccaggactcagattcatccctcagcacaggggcctgcctgtgttgacttgctgtccttagggaggagttgaaactgagggtaaggccatagatgccaggagatgccataccagtctgctaggggaaagggtgtagaagcccttccaacatcacctctctctaggtagtgtgtgtttattttcataggggcccttgaggtccagttcatggcagtgactccggtggtatttgtgacaacagactgaccttgccttatccttgggtaggagctggtgtgacacagcctcacctattctgttttccccctccaactttcccttatcttggtcagtcagatacagtttgatagagaccctcccacccccctctcccaccccctgccacccctggctgggaatcaggaaacctaatttgtataaaattcaagcagatcactaacctgtctggatctgagtttccctcctcgtgagctcaggatgactgctcccatcttcttagccctctctgctccctgcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331979 - DNA, 2301 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331980 - DNA, 2989 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagccttggctcactgagcccttggggcttcctggggacaactcctgaacctggccattccatgtgcaggatcatgactgagatcatagaggtgcaaatgctggacgagctgctgaccctgctctccagcagtgacttgcacccaggactcagattcatccctcagcacaggggcctgcctgtgttgacttgctgtccttagggaggagttgaaactgagggtaaggccatagatgccaggagatgccataccagtctgctaggggaaagggtgtagaagcccttccaacatcacctctctctaggtagtgtgtgtttattttcataggggcccttgaggtccagttcatggcagtgactccggtggtatttgtgacaacagactgaccttgccttatccttgggtaggagctggtgtgacacagcctcacctattctgttttccccctccaactttcccttatcttggtcagtcagatacagtttgatagagaccctcccacccccctctcccaccccctgccacccctggctgggaatcaggaaacctaatttgtataaaattcaagcagatcactaacctgtctggatctgagtttccctcctcgtgagctcaggatgactgctcccatcttcttagccctctctgctccctgcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331981 - DNA, 2352 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagccctctctgctccctgcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331982 - DNA, 760 bp, Homo sapiens
  misc_feature (40)..(40): n is a, c, g, or t
gcgactcttgtaggatccccggcgcatggggtctgtatgntgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331983 - DNA, 1586 bp, Homo sapiens
tctgatgactctcttgtgccctttctcctctcaggtgccagatcggctagggatactcactcacctgtatagggactttgataaatgcaggtttgctgggttttgccggaaaattgcagaaggtactggaggtggggggtgggttttatctggctttgttctccaaagatccccagttgggagattgagtggggttcagacaggactgacaacaattttcctctcaccaagtgacctcagttctctgccaccactggccttggtggtggtgggccttggggtggaggcagaagggcacgtgggtcgtgttgacagttttgtattacctgtgtttttttctttaatagctatcatggcttgcttaggctgtatgcctgtttctgaggaatttatgaagcagttgtcctttggacaaatctataactttcttttcctagccaattatactcaaagaactaggggattatagagaggttaggcatattttgttgggtgtcaggagatgctgaacagagggcttgtatatctgtacattgctctttctccactgtgaggtccatcctgccttaatttgggttcctgcagcctcagggcattctagggctctcttagatcctgctggactgagtcccctctagaaaagaagcaggaacaggctaaccaacagcagactgttagaagttggtggagggcactgacaggagtaccagccagctgttcagctaggatcctgggtccccagagctgacagcctcataggaacagacttacagtaactcagtgttgagctggatgcatactaggtgccagtgcattcctttagtgggtgctgccctcccttcctgagttggggggcctgagtgagcacctctgtacagggcacccctctacagagggaggtagctggtatgtttgtcagtggagacttgcttctccacctgccacgaggcgggcatccatccggcagtagactcctagctcagggtgctcctgtgatggctgccttgcaacagagagaggatagcccaggaatggcagctccctcctttctcaccagtttccttcttccgtcctccctaccccaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331984 - DNA, 2147 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331985 - DNA, 2160 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcaggtgagctcactgactggcccagctccaggtcctggatctgctccttccttcactccctgtctttctctccttagccttggctcactgagcccttggggcttcctggggacaactcctgaacctggccattccatgtgcaggatcatgactgagatcatagaggtgcaaatgctggacgagctgctgaccctgctctccagcagtgacttgcacccaggactcagattcatccctcagcacaggggcctgcctgtgttgacttgctgtccttagggaggagttgaaactgagggtaaggccatagatgccaggagatgccataccagtctgctaggggaaagggtgtagaagcccttccaacatcacctctctctaggtagtgtgtgtttattttcataggggcccttgaggtccagttcatggcagtgactccggtggtatttgtgacaacagctcctacccaaggataaagcaaggtcagtctttgtcacaaataccaccggagtcactgccatgagaagtcctgtga

SEQ ID NO: 331986 - DNA, 110 bp, Homo sapiens
tgggactcacagagcagcctgtgggggcaacatagcttctgtaagcctttgtaactccttcttcccttgattggggccagctgatcgggacagacaagtgtgtggagagg

SEQ ID NO: 331987 - DNA, 274 bp, Homo sapiens
tacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagtta

SEQ ID NO: 331988 - DNA, 777 bp, Homo sapiens
cagcgacggtagcagcagcatggccgcgatctatgggggtgtagaggggtgagtgcggcccggcggagggagcctgggcccgaaggcggggcggaaggccgtggccagcctggcaagctggtggccttgatcctcggcgtccgggcactttgggcggcgggaccttgcggtgaagaggtgtgtgcacgcgcaggggcgccctggagcgcacagctgtatgccttacggggactctgcctgtgcaacagccacaccccgggttggggatcctttgtgtttcttggcggaaccacgcccctttcttccacgaaacacccactccgctgtcttcagctggagaagcagctcctttttcctattcctgacctcggacagagttttgcagaacaggtgtcaggtgtgaaattgctgagcgcgggcagggtggggagtgggagtggggagaagcgggacaaagatcttggctgaggttatccgggagctggagcagctgcgagccagagtactaggttgtcctgatgtctgaaaaccgctccatccctgttggccttccatgctgctttcactagattgcatttttctgctcagaagcttgtttactgaactttttgtaatagctctgcccctgggtatgaccatggacaagatatttaccctccctgggctacagttaccgtatgtgcaaagtgaggatagggataaataagatcgctatgtccctgccagtggcaacattctgtgaatctgagtttgtcaaatcagggaataatgggggtc

SEQ ID NO: 331989 - DNA, 2333 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331990 - DNA, 1958 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcagggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331991 - DNA, 2248 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagagggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331992 - DNA, 1785 bp, Homo sapiens
gcctgggaattcagccatctgtgacactgagacagctagcaagtttggactagatgagtttgatgactgcagagggaaagacctccaagacttagtccctggtgtcaaaactgtcataatctcacccagtctcatggcttcagttgccacctacaaactacaaatgtgttggaagagcacagggctttggagagctgctgagaccttggtttgaatcccagctttgctgctcagtatctgcgtaaccctgtgtaggttactcaccttctctaagcctcagtttcctcatttggaaaatgtgaatagtagctacctcagagttgttgggaaagtaaaatggcatgatacattgcaaagtggttagtatagagcctgacccataagcactcattaaatgttagctattatttactcctggttcagatctttctcccaagttgcggtagctccagctactccctggacatatatgtgagatgttctgcagacacaggcaaacctcgtgtataccaaaccaagcttacctctctccatctcccctcaccttgccccgctgcctgatctttctgttaagagcactactgcccttccaagctccaaagctggcattgttgaatcccctctttcttctgtccatccccagtccaggttgttcttataaccacagccttctgaggggtcattgtgtggggagaaaggaggactggggctgggtgaacagggtatggccagatggggagaacaggaatcaggcatcaggagggggcgggggttgagaaaagagctggggctggggctctgcacactcgctcacctcccgcgtggcctagggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331993 - DNA, 1816 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcagggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 331994 - DNA, 2053 bp, Homo sapiens
tatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctatatctaactttctaggggtgtccggtcaccctcaatcgggactggctgaggaaggccttggtcctccctttcaaaccaccttagaaaattggtttccccaaaaaaagggggcaaatctcaggcccgtccctgtaaggccgaggtaaacggcgaccggacacctgacttggggaccacgaattgtcttcgctcagaccc

SEQ ID NO: 331995 - DNA, 825 bp, Homo sapiens
attggttcctcaggaccttagaggtgttaaagatgtataagtttgttgggattggaaggacctaccttctgtggtcaaataagttttgggagaaacaaattgatttcttgattgcaggacttctcagagcctttaatttgctaatgtgcattgtgactccccaagggagagttacaatatgcaatattccttggattcctttgaccaaagaaatcttttcaagagcaccccaacccagctactcaggaggctgacgtgggaggattgcttaaggccagcctaggcaacagcaagaccttgtccctaaaaaggaaaaaaaaaaaattacaaaaaaagagcagctcaagaaactataggaaacactttggttaacacaaatctgttctctgtgctgccttcaaactaatctataagaaataatgaagtccatgttagggaacacagataacttttctcaaatgagaaatctcaaatccctgtactttggagttaaaaaaaattattctagcttttccaacagtagagacattaggaaggccaactttggtgggcagattggggattttcctttgcttctgatgactctcttgtgccctttctcctctcaggtgccagatcggctagggatactcactcacctgtatagggactttgataaatgcaggtttgctgggttttgccggaaaattgcagaaggtactggaggtggggggtgggttttatctggctttgttctccaaagatccccagttgggagattgagtggggttcagacaggactgacaacaattttcctctcaccaagtgacctcagttctctgccac

SEQ ID NO: 331996 - DNA, 1833 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatac

SEQ ID NO: 331997 - DNA, 2557 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaa

SEQ ID NO: 331998 - DNA, 2499 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatggggtaactatctccttcctgctgtaatcagtgaccagacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaa

SEQ ID NO: 331999 - DNA, 1623 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatac

SEQ ID NO: 332000 - DNA, 1495 bp, Homo sapiens
cggttttacccagggctccctctgctttgtgtcttgtagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaa

SEQ ID NO: 332001 - DNA, 1382 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactccacgagttctttcaggtctgccaaccagccgagctgcatgcctgggtataagctcgggtcggaatatgta

SEQ ID NO: 332002 - DNA, 1112 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatggggtaactatctccttcctgctgtaatcagtgaccagacagaacctccactcaatacaccagaaaacagagagtatcttggacatctcgacaagtgggtgaacgtacgttaacggggatagtcattgacagcggagatggagtcacccatgttatcccagtggcagaaggttatgtaattggaagctgcatcaaacacatcccgattgcaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagactgtggctgaccatgggtaactgacaccgtggagcgggagccgcagataatggggggctgctggaaatggagtgctccgcgtgttctctgtttccggcttccttcactcggtgcttttgaggtgtgcatgtcatttgacccttcttt

SEQ ID NO: 332003 - DNA, 2501 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaa

SEQ ID NO: 332004 - DNA, 2411 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaa

SEQ ID NO: 332005 - DNA, 2355 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaa

SEQ ID NO: 332006 - DNA, 1414 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactgtaagtccctctctcgagggctctgtgtctccattcctgtgctctcggttgagtttgggtaaatactgtctacgaaggtgaaatagtgtgtgccctaatcgtg

SEQ ID NO: 332007 - DNA, 1154 bp, Homo sapiens
agcggggcggccgccgagcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagactgtggctgaccatgggtaactgacaccgtggagcgggagccgcagataatggggggctgctggaaatggagtgctccgcgtgttctctgtttccggcttccttcactcggtgcttttgaggtgtgcatgtcatttgacccttcttt

SEQ ID NO: 332008 - DNA, 420 bp, Homo sapiens
gtgttctttgagtctccagcaccaacttccccttcttggtcttttgctaatttcacaggaaatgattgtttttcctccacagttcctgtgtccttctggtcactaacccattccaccattgttgtgggaattagggaactaggttagtccctgtttctatggacacatcctctctcttctagatgatgaaactctctgcaaagccaggcttagcctttagccactggggcttcctgcgctctcagggtgtctgatctcagccccacccgccagagctcatctctggctagcctgggatctgtatcagcagcagcccagtggggtccatttccatcgtatctctatgccttagttcttcccttctcacccatgtgttctccagaatatttctctttatttcatgggcttttcacatagctg

SEQ ID NO: 332009 - DNA, 227 bp, Homo sapiens
acagctgcatcatttctcattctcttctacctaaccttcgatgctgatgcctctgttccctctttggattctgtcactgccgctggatccttaggatttgactcctcataactgaacatcttgtcacttgtctatcttatcatttctactcctttttttaagctttgacctacttgtacatgaactcgtaccctaatatccattctcctatctaatcttcacatctc

SEQ ID NO: 332010 - DNA, 1899 bp, Homo sapiens
tcaatcataaaaattttttaatttttaaaaagatttaacaagttaacataaaattaaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgta

SEQ ID NO: 332011 - DNA, 542 bp, Homo sapiens
acgctcgacctgtgtttacttttcctaacgtggtggaagcccatttctcgttttcggtgatgtccagaattaatttttcattcgttgcaaggtaatccgtccgtctacttacccatcagacgttttgacagcccttcatggagccgggtcttagggctgtaaaggtgataaacccaggattcctgctcattaggagctaattgggcagagtgtggtgggggagacagacaaattaaatattttgataacagtgtactgtaagttgattgtagtaccttgtactgctgtagggatgggaacagagtgctgtgagagcccagggggagtggataaattcctaactagacttgaaggtggggaccattgaaatcagtttcatatgctactccagagcctaactacagcgcctggcacatggtagacattcagtagcgtgttaaaattatgtttaatagtttttaatggtttctgtgactgttgctttgttttgcaacgtctgaatgtagtaatgtgactcagagcttcaaagtaagcattcgtta

SEQ ID NO: 332012 - DNA, 3387 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgta

SEQ ID NO: 332013 - DNA, 2171 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgaaaacaacaacccccaaccccaaaccccaaccaactccccctccccccctcaacccaccccccggaaaaaaataaaatacatgggcctcctttggcctcacgggg

SEQ ID NO: 332014 - DNA, 2143 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgccaaaccacagctccaccatcacaccacacgacaccaaacaaacttgcccctctcggcctcagcgcgggacttttgg

SEQ ID NO: 332015 - DNA, 2127 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaaacggagtctctctctgtcgcccaggctggactcttggctcactgcaacctctgcttcccaggaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattg

SEQ ID NO: 332016 - DNA, 2668 bp, Homo sapiens
taagaagtgcccaccaccatgcccagctaatttttgtatttttagtagagacagggttttgccatgttggccaggctggtcttgaactcctggcctcaagtgatccgcctgcctccgtctttaaagtgctgggattacaaatgtgcgccaccatgcctcgcttttgctgctcatttgtacgtacctctgggacatgaatgaagatcagatagttcagcctagattaattagttcttgtgttgtgggtcttagacagcagagacatgacctgggtagctgtgggtctaactgtgtgggctgttaattacttacttaactaaaagatgattgatgataactacatgaaatatttcccaatagaaaggaactaaaattcacagaagagtgttgctctgagtgacttggtcagaaggctggctgtgttctggagtgccattcctgctgggcaatgagaattctgtcacaatgaggactgtttgggaatgaatccctattttacatgttgattatcttaggaggaacctgcctttttaactagttttcagagcataggactaaactgtcattttatagcataaaaaaattgatacataatattttacatatttatagggtacatgcgatgttttgttatatgctgttctctaactaacattttttaaactgggagtaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgta

SEQ ID NO: 332017 - DNA, 2653 bp, Homo sapiens
agacggagtgttgctccttgtcgcccaggctggagtgcactggcacgatcttggctcactgcaacctccgcctcccgggttcaagtgattctcctgcctccgtctttaaagtgctgggattacaaatgtgcgccaccatgcctcgcttttgctgctcatttgtacgtacctctgggacatgaatgaagatcagatagttcagcctagattaattagttcttgtgttgtgggtcttagacagcagagacatgacctgggtagctgtgggtctaactgtgtgggctgttaattacttacttaactaaaagatgattgatgataactacatgaaatatttcccaatagaaaggaactaaaattcacagaagagtgttgctctgagtgacttggtcagaaggctggctgtgttctggagtgccattcctgctgggcaatgagaattctgtcacaatgaggactgtttgggaatgaatccctattttacatgttgattatcttaggaggaacctgcctttttaactagttttcagagcataggactaaactgtcattttatagcataaaaaaattgatacataatattttacatatttatagggtacatgcgatgttttgttatatgctgttctctaactaacattttttaaactgggagtaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgta

SEQ ID NO: 332018 - DNA, 1993 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaaatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattg

SEQ ID NO: 332019 - DNA, 576 bp, Homo sapiens
gctggttttgaactcctgacctcaagtgatcaatccgccttggcctcccaataatctttgtaattttaggttaggtggggtttcaccatgttggccaggctggtttcaatctcctgacctcaagtgatccgcccgcttcggcttcacaaagtggtgggattacaggtgtgagccaccgcatccaacctgaaatttgcttgtttttagcaaaattaattaatgcaaaggtgtattatatgtaaaggtcaaatttgggcagcttactacattgcttttcttgcaggacgatgttcaactttggctctcctatgtggctttttgtaagaagtgggtgagtaaagccatgcatgtcttgcttcctctgaccgtctttttgttaatctgccctttaagcttcatgccagatgttttttcctgaagtgtagggttaacatgaaaaaagaacccaagaaggcggaacatcaatataacattggatatctgaatgactatggtttccaattcaattgaaaagaatataatttttatgtgtgtttgttcaatacagttgactttttaaaaagatatttaaagtgt

SEQ ID NO: 332020 - DNA, 564 bp, Homo sapiens
ttgaagtaaaggtgtaggatgactgtttttttccttatcttttaataactttgatgtgatgaatgttgaactaagtgatctgatcaacacaatctttctgacttttccagaggccatgtggaagtgttacatcaccttttgcttggaaagatttactaagaagtcaaatagtgggttccttagagggaaggtgaggttgttacatggttacagtggttgactagatagtgactgccttctgaaagaacagaagcacagatcttttggtgtctggcacagtttctgagaacttttatgtttagccactctctctctccttgtgggtgacgtgacattctaaaggtctgagtctggtttgccgccaggttaggaggggctctcgtgtaactgggctctgttcggtgcagctgcccattgcatctattcataagtgaaaccaccatgcaggagcaagtcagcttctttgaattttaagaaatgcgcaaaactgcttttgttcatgtcagaggccagaggcccctgctgggatctttgtaatgaactgagggatttttctgttttcag

SEQ ID NO: 332021 - DNA, 2066 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattg

SEQ ID NO: 332022 - DNA, 923 bp, Homo sapiens
acgctcgacctgtgtttacttttcctaacgtggtggaagcccatttctcgttttcggtgatgtccagaattaatttttcattcgttgcaaggtaatccgtccgtctacttacccatcagacgttttgacagcccttcatggagccgggtcttagggctgtaaagggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaagggtcttactctgtcacccacgcaggagtgcagtggtacaattatggctcactgtagcctcgacttcatgggctcaggtgattctcccatttcagcctcctgagtagctgggcatggacctctatgcctggctagtttttgtacttgta

SEQ ID NO: 332023 - DNA, 1918 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaaatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattg

SEQ ID NO: 332024 - DNA, 1406 bp, Homo sapiens
  misc_feature (57)..(57): n is a, c, g, or t
  misc_feature (75)..(75): n is a, c, g, or t
  misc_feature (141)..(141): n is a, c, g, or t
  misc_feature (183)..(183): n is a, c, g, or t
  misc_feature (356)..(356): n is a, c, g, or t
  misc_feature (389)..(389): n is a, c, g, or t
  misc_feature (422)..(422): n is a, c, g, or t
  misc_feature (454)..(454): n is a, c, g, or t
cgattctagaggatccccgtcagatgctccagctcaccagcaatggatccaaaccantgacaaaatctctgatgntgccagaagaataattcagaaagtcaagtattaatctaatcaaggaggcacagagaaggatgaagntacaacttaaactaaatcaaaaacatgatacaggatgtgaangaaaaattcttcagtgaaacagagatcataaataaaaaacaatcacaacttctggaaatcaaggacacacttagaggaaataaaaaatgcactagaaaatctcagcagcagaactgaacacgcagaagaaagaacttcagagctcgaagacaaggcttttgaattaacccaantgcatcaaatgacaaagaaagaattttttaaanttgaacaaagcctccaagaagcttgggactatngcttaaatgtccaaacctaacgaactaattgngtgttccccaaagaacgaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattg

SEQ ID NO: 332025 - DNA, 3448 bp, Homo sapiens
ggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaaacggagtctctctctgtcgcccaggctggactcttggctcactgcaacctctgcttcccaggaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgta

SEQ ID NO: 332026 - DNA, 531 bp, Homo sapiens
gtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtg

SEQ ID NO: 332027 - DNA, 364 bp, Homo sapiens
accaattcttggggtataggttatggaggcaattaatcctccataattaccaggaggcaatttatcctacataattgatcaggggtctgtggctagtccagacccctgatcctagacagggctatgctttacaaatataatattcccctccattaaacattattttaaaaacaagaactctggttagagtaaacagactttgttggtttactatgaaaatttatgctgaagttcggagtggagctgcactgatgaaagtgagtagggggctggagtggtttctcttctgtcccaagtagtcctggatgcagccatctggtaccctcagctctgaggggtccagagcaaaaactactgcacactt

SEQ ID NO: 332028 - DNA, 358 bp, Homo sapiens
gtgcggttgaggtgagaagggatcttgcagaacgcttccaggacccagattcgtatgcacgccctgcccagctggtcagcctcagtttccccatctgtcagtctggacagtgacgctcccagcgtccggcgaagccccgctcttggcccttggtccctccgcctgatcacaagagggtgccgcgacggccggggacgggtctggcgtgggcagggacctctccgaccctcattgaggaaagaatggcggaacccgaaaaccgggccctggcgtccctcctgcaaggtggggaggagagctggacggcaggatttgggaagggcttggggagcagggccccctgagggtggcgggggag

SEQ ID NO: 332029 - DNA, 2328 bp, Homo sapiens
ctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgcactcagcaatgttgtggaatgaatgaatgggtggatggaacaagtgcttttttctccatgaacgactcaaaaggaaggtttcacactcttgatgaactgcagactgtccgcctggaccgggaggggattactactatcaggaacttagaaggcctccagaatcttcacagtctctatctgcaaggggtaacttctttctccacccttcccctccccttgacccctgtggacctaatctgtctcatctgaaaggagccaaccaggtcatcctgcccattccctggtgttcaggcaggcagaccttcatttaaaccattcccagacgaatgacatagggtcctgaattgaaaaactaattccctcaaaatagatcctgaacatgacctgtgctccttccactgttctttaggcacttctcttgatctagaagttctttttggcatctactctaaatctttcacgttaaatagctccagcccatttcctgttttgaagaagaggaaactatgaagattcctgtacatcattcagatcctacttgaaggctgtttggtggtggtggtggtggttggttgatcttcagccttcccctggttgagtattcccagctcgcttcaactttccccatagaaactttaaccgtcaagttcctgtatgctcattgttctctctgtgtatgcaagccaccaccaaggccctttccgttttcctggtggcttcttagtttccttttctgattcccaggtcactctttggttgtggaatcagaagagtatacgtagtcaggtttagataccccaggtttacacccttaaccatccacatggggaaagaaaatcatctttcttaaggtagtggcaacctgttcaaggagtggggtgatcattcccaaagtgccagatctccagctgcagagtagacatggtcttggggctttgtccccgtaaagggcccctgacgcatctgatctcagcttggtttccccacttcggtttcttcttgcagaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccct

SEQ ID NO: 332030 - DNA, 508 bp, Homo sapiens
  misc_feature (74)..(74): n is a, c, g, or t
acgactgatcacacgcgagacttctcatgaaagctatcgtggcaacactatatactgtccgcctgctcgtcgantacgttttaggggattactactatcaggaacttagaaggcctccagaatcttcacagtctctatctgcaagggctccagcccatttcctgttttgaagaagaggaaactatgaagattcctgtacatcattcagatcctacttgaaggctgtttggtggtggtcggcggcggcggaaagggcgcaatccccccacacgagtaatgctcaaacagatgctgcacaactgacggaggcataaaaatacatgcggagaccacagacaggcgtcccactgaaaaacgggggaagtggatcactcacacgcgaagttgtgtctcaagggcggttgaacttctcatccggatgtaacacaatcgggcgtggccaccccgcgcgggcgacaacaactaacctgagctgtcgactatacggaacctctaataattcagggcg

SEQ ID NO: 332031 - DNA, 1614 bp, Homo sapiens
ctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgcactcagcaatgttgtggaatgaatgaatgggtggatggaacaagtgcttttttctccatgaacgactcaaaaggaaggtttcacactcttgatgaactgcagactgtccgcctggaccgggaggggattactactatcaggaacttagaaggcctccagaatcttcacagtctctatctgcaagggaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaaaagcga

SEQ ID NO: 332032 - DNA, 1380 bp, Homo sapiens
ctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgtttcacactcttgatgaactgcagactgtccgcctggaccgggaggggattactactatcaggaacttagaaggcctccagaatcttcacagtctctatctgcaagggaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaaaagcga

SEQ ID NO: 332033 - DNA, 189 bp, Homo sapiens
taagcggaacttgactttccctgaagatggggaactgtcagagaagatgtgagtgcatgggggagaaaaggggtgctagaaggctgaaacactcaggatgaccaggtccctgacgtgtactgatttgtcaactgatctttgtttctctccttactccacacattcaatcagtggtaatgcccagctgat

SEQ ID NO: 332034 - DNA, 1535 bp, Homo sapiens
ctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgtttcacactcttgatgaactgcagactgtccgcctggaccgggaggggattactactatcaggaacttagaaggcctccagaatcttcacagtctctatctgcaagggaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaaaagcga

SEQ ID NO: 332035 - DNA, 1658 bp, Homo sapiens
ctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgtttcacactcttgatgaactgcagactgtccgcctggaccgggaggggattactactatcaggaacttagaaggcctccagaatcttcacagtctctatctgcaagggctccagcccatttcctgttttgaagaagaggaaactatgaagattcctgtacatcattcagatcctacttgaaggctgtttggtggtggtggtggtggttggttgatcttcagccttcccctgaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaaaagcga

SEQ ID NO: 332036 - DNA, 224 bp, Homo sapiens
ttctttttttctaattcatttttaaagtatagtttgggcagatgtagtgttcatagtaggtagttgttattttttcatcactttcaatatatcatcctgccatcttctggcttgtgagattttttgctgagacatctgttgatcattttataagagtggccttgtatgtgccaagtcatctttttctttctgacttcaagattctctttgtcacttttgaattt

SEQ ID NO: 332037 - DNA, 323 bp, Homo sapiens
cctgcccccttgtcttgtatgcaataaataccagcgagcccagcctttctgggccactaccggtctcctcaacttgatggtagttgtctcccaagcccagctgttttctctttatctttttgtcttgtgtctttacttactacaatctcttgtctctgcacacggggtgaatacccgctaagccccatagtgctggaccctataagttctatatatatgcattgaagggggcctgaccctccacacctgtgggtatttctcatcaggtgggatgagagactcagaaaagaaagaagacacagagacaaagtatagagaaagaa

SEQ ID NO: 332038 - DNA, 261 bp, Homo sapiens
aaaatatacaacacttgtgccttgtcatcaaagcttctcagggacctagaaatgaaaatccttttcagctccaatttcccttcctttctcagagatgactgagatattttggtgattatctccagctttttcaatttatgcaaaatcgattttctgctcacttgatttctagctccccttgcacagacaacttccgttagatgatcaagcacccaccggtagaaaactagagtgaaaggtagagttaaaccctttcctctc

SEQ ID NO: 332039 - DNA, 239 bp, Homo sapiens
tgatgtctctggctatatcagcatgtggttgaaacaggttagttacttctggaatcttcacagaggaaaaaaaaaaagaaagaaacaggttagcaactattacttgagactgaattaatgctctctgtaagggctgagtgttccctccaagctcaccatctattctgaatcaatcaagaaaaaaaatggagggaaataaaaccacaaatgaaaaacatgattttttttttctttttttg

SEQ ID NO: 332040 - DNA, 135 bp, Homo sapiens
ctcgcccagtcgctgccctctcctttcccgcagcccgcggggcctgggctctccctgccagctcctcctgtgtccacttcagccttcccggttccccaggcagcctgtcctgccggtcactccgtctcccacctg

SEQ ID NO: 332041 - DNA, 431 bp, Homo sapiens
ctcctttatttcatcttctgtttctctttccttcgctctttcctctccaggcgcactggccttctaatgtattccttacatacattcttaaatacaatttcattgctgcttgtggactttgcacttggccatttcttctgtctgggatgcccttctatcaaatctctgtaccaccaactccttatcattcagaactcgctcaaatgttgcctcctcaagagggcctctcctgaccatcctacccaatgttgctcctgccccaggactctttgtcctatacccctcctgttctaacatcttcctaattcttatttcaatctgaaaacaaatgacttatatgttatatgttcccttttttattggcttctccctactaaaacttcaagagagcaaggatcctcttttttttttttttcttctgagacagagtc

SEQ ID NO: 332042 - DNA, 1108 bp, Homo sapiens
gcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccagaaaaaaaaaaaaaaaaaaaaaaaaaaaaaaagggggggcgggcccaaaagtttcccccggggggccccaaagattatacgcgttccccgcgttttttggttcacaacggggggccccccataatgggggagccgaattataatacacctagggcacctggcgcgcgccgtgttgtacaacgcgtcgtgcaccggggaacaccgtgcctcaccgtgggggactccgtgcgagagggaccccttatactccgggggggggccaccttagttggggcgaacaccttacag

SEQ ID NO: 332043 - DNA, 959 bp, Homo sapiens
gcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccagaaaaaaaaaaaaaaaaaaaaaaaaaaaaaaagggggggcgggcccaaaagtttcccccggggggccccaaagattatacgcgttccccgcgttttttggttcacaacggggggccccccataatgggggagccgaattataatacacctagggcacctggcgcgcgccgtgttgtacaacgcgtcgtgcaccggggaacaccgtgcctcaccgtgggggactccgtgcgagagggaccccttatactccgggggggggccaccttagttggggcgaacaccttacag

SEQ ID NO: 332044 - DNA, 643 bp, Homo sapiens
aggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccagaaaaaaaaaaaaaaaaaaaaaaaaaaaaaaagggggggcgggcccaaaagtttcccccggggggccccaaagattatacgcgttccccgcgttttttggttcacaacggggggccccccataatgggggagccgaattataatacacctagggcacctggcgcgcgccgtgttgtacaacgcgtcgtgcaccggggaacaccgtgcctcaccgtgggggactccgtgcgagagggaccccttatactccgggggggggccaccttagttggggcgaacaccttacag

SEQ ID NO: 332045 - DNA, 682 bp, Homo sapiens
gtggagccggaagcaggaagcagcctgtgctccccaggacctgcctggttgggggaattggaggcttctaggaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccagaaaaaaaaaaaaaaaaaaaaaaaaaaaaaaagggggggcgggcccaaaagtttcccccggggggccccaaagattatacgcgttccccgcgttttttggttcacaacggggggccccccataatgggggagccgaattataatacacctagggcacctggcgcgcgccgtgttgtacaacgcgtcgtgcaccggggaacaccgtgcctcaccgtgggggactccgtgcgagagggaccccttatactccgggggggggccaccttagttggggcgaacaccttacag

SEQ ID NO: 332046 - DNA, 267 bp, Homo sapiens
tttagggagccactattcaacccactatgactgcccacccctgtttcttcttggagttgcatgagaactttgggggtcaatccactcactgcaggctgggcactgagctgacagcagctgcctctactctgcctatagcagtgccctgagtgttgtggtcaagtggtctcgatcctttagacctttaggcaatgggaagaccttatataaagagctcacagagcagctctgggattagctacttttgaacgtcagagtggtaattcc

SEQ ID NO: 332047 - DNA, 331 bp, Homo sapiens
tttatgtcagttcctggaattattacaggtgatgcacgatttttgctcctttagctaagcaaggtccaggttcttgtctcatgaccaggaaaaattaggcacgtggacaccagagagtgagtgcagtagaatttattaagtgaaaggaaagccttcagcaaagagaaggatcctgaaaaaatggtttccggttgcccccttcccagttgaataccctggcttgtatctaaaaaactgatgaggctgggttccttatttgtatatggcgtgaattcctggtggctccaccccatccttccagtgcgcatgcaggcccttagactgagctgct

SEQ ID NO: 332048 - DNA, 329 bp, Homo sapiens
gatttgaacaatagatctttagctaccattttagcaagaaatctcccaattcaaaatacatccctacagcccatctgcctaaattgatcagcactttatctggcctggaatacaattcaactttcagattttcacgatgtaatatatttgccaactgcagattgtagaaactgcagccagattggctatacctcacactgggtctttagcatagaggagctagttaagaacaacaaagcaaccatcatgtttttacagctgtagcttcaatcgaggaaaattacctcagtaaaaaggctgtctgcaatgaccaaccaggaggtacaagg

SEQ ID NO: 332049 - DNA, 533 bp, Homo sapiens
tcttaacatgtaggatattttctttctttccacttaatgttctgctttattttgtatgtatttctttcctttgaaagtcacaatctttcaatctttttctgttcaaatcctttccctacctttgaggttgtgcacttcacactgtacatataaggcaaagtgtatacattaaactccagataaggaaaatacaacctaacatgtatttaccatttactatgtaccaagtatttaccacttacaatgtactcttctaaatactattttatatgtgtattttattttaattctcatagccactttgtatcatagggacttttatttgtattctttattttttttttttaaaaaaaagggatacatgtgcagaacctgcaggtttgttacttaggtctatgtgtgccatggtggtttgctgcacctattgatccatcctctaagtttcctcccctcacaccctacccccaacaggccctgttgtgtgttgttcccctctctgtgtccatgtgttctcattgttcaactctcatagg

SEQ ID NO: 332050 - DNA, 539 bp, Homo sapiens
tagatgcctcctaggaggtggtaccacacttagtgagtcccaccttttaaaaactgcagagtagggcgggcgcagtggcttacgcctgtaatcccagcactttgggaggccaaggcaggcagatcacgaggtcaggagtttgagaccagcctggccaacatagtgaaactccgtctctactaaaaatacaaaaaaattagctgggcatggtggcaggtgcctgtaatcccagctacttcagaggccgaggcaaggagaatcacttgaacctgggaggcagagattgcagtgagccgagatcgcgccactgcactccagcccggcaacagtgcaagactctgtctcaaacaaaataaaacaaaaaagctgcagagtattctatgttaggtaagttcatctatatatgatgattaatatttatttattgttcaatgatatactatagttcagggagcttcttgcacagacagagacaacattgtatagtagttcagaacatggactgtgagcctagattacctggattaaatcctggctct

SEQ ID NO: 332051 - DNA, 507 bp, Homo sapiens
actaagaatgcatgtgcacagaggaaggaccacgtgaggacacagcaaaaaggtggacatctacaagccaagcagagaggcctcaggagaaaccaaccctgcccacagcttgatcttggccttccaggctccagaattgtgagaaataatttccattgtttaagctacacagcctgtggtattttgctatggcagcctaagcagatgaatacattcatcaaaattaaaacattctgcttattaaagaaaataaatacacaaacccacagactgataaaaatatttgtaatacatacatattacatatccaaatatgtgtacaattcatacacattaacaataaaagacaaacagctcaatttttaaaacaggcaaaaaattgaacagacttttttacaaaagaaaatatatgaatggccaatgtgtgtgtgacagtgtgcctaacatcattagtcaccaatttaacgcaaattaaaaccacagtgagatatcatttcacacccacga

SEQ ID NO: 332052 - DNA, 222 bp, Homo sapiens
ctgggcattgacagatgagtcacactgtgcctcatgatgcagtgtgcagaactggtccagccagggtcaagtggatggctctcaggccagtccacaccctcctctgggggaactagggcaagtctgctggctgcctcagtccttccctgtgaatgcagcccattattcctgaatcacatccttgtctgccattggtgattttgggtgcttcgtgggctttgg

SEQ ID NO: 332053 - DNA, 582 bp, Homo sapiens
aacgggtgatgcggttggcacgggcgggcaggatggcacaagcaggtcagggtggcacgtgtgggtagggtagcacgggtaggcagggtggcttgggccacaccaggcctggagagttaacggcggtgccaggggagggtgcagaaggggcctggtcccaacaccgcccacacctctctcagggccatagccccaacgcctccccaaccaaaccaactgggcttccctcagggccatcctcactctccttcaacacccgtgagaactggtaccacctggggccgcccagagagacaactcaaggttaacgtttggctcggcaaagagccaccaagaaatttctggcttcacagggaaaaaaacgaacatttccttgtgggagataccacatggaatgtgtggccggaggggcttctggaaacgatggtcagtgacgcaggtggcaccttgtgggttaccacgacccagtgcgggggagagcagtgggctccggccactgcagctgacaatggaggacccgggggtccagacactcccggcacagagctcttacccacaactaccaacatccagcgaccacca

SEQ ID NO: 332054 - DNA, 391 bp, Homo sapiens
cccccatcctgcggggtctgcactaactccggggagtgtcaggatggaattgtgggatacccagttggtatccagatgtccgaaaatcggtgtagaaactccacatgcacatttggttagaggtgtttgaccataactactattcaagaaaaagatctactcattagaaataaaaatcataaaattatacattctacaaaaacaaatcaaccttatctacctcccaatcctaccaaactacagaatgttagaacagaaggtctgaccatggactcaagagctgacgttaggaatgtcagcaccatcctgctctccaaggactcctcatcttcaacagactcctcatcttcaaaggaaagggtggaaactgcaacttgtgccatgatccctg

SEQ ID NO: 332055 - DNA, 403 bp, Homo sapiens
tatcctaggcctagtggatggaggggcaggcacagaagatgtcgtatcatctagctaccttagctaccttttgacccttactgggagacaggatacaaaatttttcttgttgtctaagtatcaagtgagtcagactactaatggtaggtagacaaacattatggtctggaatgttcaagggaaattgatgacagtggtacatcctaagggcctttctgtaagcagaagaaaggatttctaggagtggtggtgctgtgcacgtgtgttagtcacagaggactaggtgagaccgctagaatgaactgggaaaaggtagagttcatttggacccttgagggacctcagttccatgctgagttaggtactaatgttttagcagggaagtggtataggaagatggtgc

SEQ ID NO: 332056 - DNA, 662 bp, Homo sapiens
tttttatttctgggtttcttacagctcctggtctctccagtccaacaggaggcctctcatccacagaagcagtcctactgcccagcagacctctttcagagccttccagacatggctgacccctggcaagcaaggggctttttgagctgagaggcacttggctgggacttcaggaattcatggacagggctggcagatactgcatatgtttgagctgtagatgggattgagaacagaaagttgaaatggagacttattaaagttaccgtggagaactgctcaaaaattcattttgaattaaggaaacttaaattcattttaagtttccttagatctaaatgcaactgcacattacactcaaatatgttccttccttctcacacacaggactcccttgtgaaactcaaggggaagttcaagttgtccatcttcatctatgaagtagtcactttatcactgtctttacagattgcacagtctggggttttgtggtttctcttgtctcactctccagccaggaagaacttgtcatttgagtttttaaaatgtatcatttcttccccacctcaaaccacttgtatcccagtttctcatttaaagggagaaatggttatatagtcctctctttgcacctgattgaattataaatgatagaaacaaga

SEQ ID NO: 332057 - DNA, 171 bp, Homo sapiens
atgaaccacattacagcaaaattacttttttgactgaaatgcatgaagtctcaccacccacattaaaagtgatttatcatgtcattaatccagtcacactatatttcagggactgactatgaatgctttaaagcttaatctttctccctcactcatacacacaaagcttta

SEQ ID NO: 332058 - DNA, 3058 bp, Homo sapiens
agtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcatggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttc

SEQ ID NO: 332059 - DNA, 2515 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttc

SEQ ID NO: 332060 - DNA, 969 bp, Homo sapiens
agtactcattgatcagggcctgatcaacccttctaattatgctcctgccaaaattgacttctcataaagtgttctctctacttacttcactatttcccttctcctgccctttttttatactttctttgctctcaccccagttattaacctctgtaagtcccattttgtcttacattcaagacccaactaaaatgtcttatttctttcagtcttataggaacatgtagttaaaagtttgacttctaaattcatgttgcatttgacccgtacctctcttttgatacttatgccaagtggtaagcaaccagttttctgtgcacagtctttctcgtgcacttaggatcgtgtatacagttcttggactatagtaggcacttgagaaatgattcagtgaacaaaagacaaatcccggttcttcctctttcaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaacccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332061 - DNA, 725 bp, Homo sapiens
agtactcattgatcagggcctgatcaacccttctaattatgctcctgccaaaattgacttctcataaagtgttctctctacttacttcactatttcccttctcctgccctttttttatactttctttgctctcaccccagttattaacctctgtaagtcccattttgtcttacattcaagacccaactaaaatgtcttatttctttcagtcttataggaacatgtagttaaaagtttgacttctaaattcatgttgcatttgacccgtacctctcttttgatacttatgccaagtggtaagcaaccagttttctgtgcacagtctttctcgtgcacttaggatcgtgtatacagttcttggactatagtaggcacttgagaaatgattcagtgaacaaaagacaaatcccggttcttcctctttcaggtcatttctactctccccatattccacaaaaatgtcttccactacttgatggcgtttttgcgagaactgctgaaaaattcagcaaaaaatcatttggatgagaatattctaggtaagcagccaaatgtctatggaaagcatttctgcaaactgagagactcgtaatgagaaatgaggttgaggagggtcccaggtcccttgcagtagaactaaaatatcaagctctgggcaaagattttttaaagcagaaagttttgcgtttggacactcctccccacgatcctaacacaagagtaag

SEQ ID NO: 332062 - DNA, 627 bp, Homo sapiens
ccttaccacctccatgcctctagaactttgccaaacaccacatgcttgccattctagccaggctgtcttgactgtcgtgatgaagaactgggagccgttggtgtctttgcctgcgttggcatgctcgcccagccaggcccgtagtgcttcagtttgaagttctcatcggggaagcgctcaccgtagatgctctttcctcctgtgccatctcccggtgagtaatatgccacaaagaaacatctagaactttgtagcagacaagccagtcaaacaagatattcctatgcctaccttcctagggacttagaaactcttcagcttcctagagcttgcttagtgtatcagctgtatattgctgtgctacaaaccatcctgaaattttagtagtttttaacaccgagttattgctcctcatgattctgtgggtttcccatgtgggtcttctgcttgtctcacctagccccatttgtgtggttataatcagatggcagctgtgatggccggagggctccagatggcctctctcacatgtcttggtgttagcttttctctgggtttcactcaccacatggactcatcattcagaaggctagctcagtcttctgtaggtagtggcaagaacatgag

SEQ ID NO: 332063 - DNA, 600 bp, Homo sapiens
ttcaaatgtttttgtttgttgttttcatattcccagttggactataaactctttgttcttgtgtctcctgcatgccaagcacatttggatgcttgttggttggctgataccttttctttccttttcctaaccctttatgccttaccctcttccctcctgccttctttcccctttcctcttggcctgcccccggccaacattatttttaaaatttctctgcagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggtaggttgtgtttaagcattcagacctg

SEQ ID NO: 332064 - DNA, 4446 bp, Homo sapiens
agtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcatggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactacaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggggtttgggaccaggctgggcaacacagggagaccccctctctacaaaaacatttttaaaaaattagctgggcgtggtgatgcgtgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332065 - DNA, 2271 bp, Homo sapiens
agtactcattgatcagggcctgatcaacccttctaattatgctcctgccaaaattgacttctcataaagtgttctctctacttacttcactatttcccttctcctgccctttttttatactttctttgctctcaccccagttattaacctctgtaagtcccattttgtcttacattcaagacccaactaaaatgtcttatttctttcagtcttataggaacatgtagttaaaagtttgacttctaaattcatgttgcatttgacccgtacctctcttttgatacttatgccaagtggtaagcaaccagttttctgtgcacagtctttctcgtgcacttaggatcgtgtatacagttcttggactatagtaggcacttgagaaatgattcagtgaacaaaagacaaatcccggttcttcctctttcaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactacaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggggtttgggaccaggctgggcaacacagggagaccccctctctacaaaaacatttttaaaaaattagctgggcgtggtgatgcgtgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332066 - DNA, 3116 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactacaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggctgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332067 - DNA, 2931 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagctcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332068 - DNA, 2940 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagagatcgtgccactgcaatccagcctgggcgacagagcgagactctgtctcacaaacagaaaaaaggtctcggggtcaccggtacaccacacgcaaaattctaaaccttaaccacctttatttttgccagaaaaacaacacacagcagaggggcgcgacggcacaaaaaggaactccccccagagggggcgccaacccattaacggggtacccaacctttcgtcggggaacacaaggggggcccccaataaatcgagaaacacgaatctaaacgaaacggacgggcccggccggcttaacacacgcgtcgcgagcgccaaacggaagcgcggcgcccgggacaacgat

SEQ ID NO: 332069 - DNA, 993 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgagtgagtctgggcttccaccccatgcggttcaccatgagtacatagagttgtgggctctgtcttttcatggggagatgcctggtggtggtttcctattgctgcaatggtggtagctcccacctcttggtt

SEQ ID NO: 332070 - DNA, 501 bp, Homo sapiens
taaggaagcttttttctttcacgataccccaaaggaggaagagtggttcaaagctgtgtcagagggtcttcatccagatgccaaatatgcaaaggtaagagaggagtcagggacctcttaattttatgttgccatgcagggaaattccaagatcatttttcaccttttccatgacctttatcttaagccagtcttaattatcccgcaattttcatttccagatcttccagaaggggtgcctccgggtgggaaagatgcagggtctcgccactcgtaggttagcacatagcatgcttggtgaattgaacagatgattacctgtgttctagtgtggagaaggagacacgtgaatactctcagccagcttccagactatgtttcctttggggtatttattcctgtttgcaatttctatttaatgccatgtctctcttttccaggtgaagcttatccgactggttgggattatgctgctgttatatgtcaaacaggagcatgcag

SEQ ID NO: 332071 - DNA, 409 bp, Homo sapiens
agccaccgtgcccggccagaaagtttgtaggtttaagtgactgacacaattaagtttgaattggatttctttggggatcctttccatagggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgagtgagtctgggcttccaccccatgcggttcaccatgagtacatagagttgtgggctctgtcttttcatggggagatgcctggtggtggtttcctattgctgcaatggtggtagctcccacctcttggttata

SEQ ID NO: 332072 - DNA, 591 bp, Homo sapiens
gactccctatagggaatttggccctcagggccaaaaattcggcccgaggtggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttc

SEQ ID NO: 332073 - DNA, 3903 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactacaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggggtttgggaccaggctgggcaacacagggagaccccctctctacaaaaacatttttaaaaaattagctgggcgtggtgatgcgtgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332074 - DNA, 4044 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgttctggagactgagaagtccaagatcaaggcactgccagctttggtgtctggttatcatcctaaactaaatttgctgccatctaaaagattcctatggagacaattctaatacaagggaactaatttggagcagacctatgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactacaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggggtttgggaccaggctgggcaacacagggagaccccctctctacaaaaacatttttaaaaaattagctgggcgtggtgatgcgtgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332075 - DNA, 2601 bp, Homo sapiens
gcggcgggatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaacccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacag

SEQ ID NO: 332076 - DNA, 1246 bp, Homo sapiens
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagtgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaa

SEQ ID NO: 332077 - DNA, 1279 bp, Homo sapiens
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagtgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaaggaagacttggtgttggccacccagcgcaacaa

SEQ ID NO: 332078 - DNA, 939 bp, Homo sapiens
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagcagtgggaaggagtcagccaagcaggagaatggctgcgcctatttgctcttgagagaacatcaccagctgctgtgtcccaagtccagttccagagcagcgtactgggcccctggtctacatgcactgaaacttatgctgccatcacggacatgtctaaaataaaagagcttttcttttatttgtacttcttttcctgctttgctattgtggattaataaaattacatgcatgaaattac

SEQ ID NO: 332079 - DNA, 1581 bp, Homo sapiens
  misc_feature (1248)..(1248): n is a, c, g, or t
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagtgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaaanaaaaacaacaaccaaaaaaaaaaaaaaaacaaaaagaaaaaaaaaatcgctgaggaggcgcgctcgcagcacgaccgcgagaaaaaagagtcttacaacaccccaacttagcggtgcgagcggcgatgcggggatcccccagcatggataacagcaccaacggtggtcaaaagacgtggttcctcagaagcaaacccggggcagacacaaacaacaaggggcgtcggaattcgcaaccccatatacaaaaaaggccgtgggggaacagcacagcgtgtctgagaaacacaactcccagagcggacgggcgaggcacaaccgaggggactcaaa

SEQ ID NO: 332080 - DNA, 1271 bp, Homo sapiens
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagtgcacccagcttgcctctggaggggatcaccccccgcccccccccaccctccccccgccatgatgccccccctcccccgagcgcccctacgtccatctcttatctctccctcctatctgccgtccctttctgctctgttcctcctcctcctccccatcccttctgtccttcttaacatcgccaaattttggcacacctctcatctccctctaccccctctccacttatacccacgccccccatccaccgcccgccgcacctcgcctcccctgtcctatctcatcccccccccccacctccccccacccacccatctaacatccccctctcccctccgctcactcctcactacgttatcgtcccctctgccccgttcccccctccgcggcacccgaccccttcacatccattactccc

SEQ ID NO: 332081 - DNA, 208 bp, Homo sapiens
caagcatcgggagcccagtggaactcgagcctctgccatcctggtttggttctgatagagttccatgaaccatccctgtcctaagtacaaagccccagaagtgagatcagataaagctttaggcgtgctcagaaccaaaagggagcgagggagagaaaagagctcccagatcccttgtgtgcctcctctttgaacaaaaacctcagaa

SEQ ID NO: 332082 - DNA, 263 bp, Homo sapiens
cgcgttctgcgtctgtctccgtgagtgggcagcacactgcatggttttttggtcattttattccttgaaactccataatatgttctttttaaagatgaatggcatttgaggccttagagaaaatacagatgatgaacttgtcttcaagaagtcatgtgtatgaatctctcaccttctaaaactaaagatttaagggcacctttgtattacagaggaacatcttgacttttaatgggtttcgtgccacgcagaacgcgcctaat

SEQ ID NO: 332083 - DNA, 602 bp, Homo sapiens
tttttcccaccattctgatcgatcccccacagaaaacaaattcacctattgtgaggtttaattgtatgtgtcaatctggttaggttatagttactcaatcaaacactaattgaggtattgccatgaaggtagtttatagatgtggttagcagttgtctgtgactgtaagtctacagctgcctttcagtgaaggagattattcttgataatgttggtgagcctcatccaatcaactggaaggccttcaaagcaaaactgaggtttccctgagaaagaaaaaattctgcctcaagactgcagtgtcagctcctgcctgagagtttccagcctgcaggcctgtcctggagatttcagacttgcagccttcacaaccacgtgaaccaattgcttgaaataaatctctttccattctcattactacttgtgctctgcctagaaggggctgaaagaaccaggggaggccagcctggctgaggacacctttcgtgtccctgcaccaccctggagtcctgcatgcctcacctggctccactctcgtctggagctgtgcctggctggagcagaagatgccagtacccttccttcttccccaatcttttttt

SEQ ID NO: 332084 - DNA, 244 bp, Homo sapiens
ggcccacctcctcccttttaaccttatcctaaccaccgctatattaggctcagaccccaaaagcctttcctaccttctctcagcttgtagattctcatgcccagatctgccagaaacgtctccccactgcctgctgtcactcttaactcctagaggcctgggtctctagccccagaaccacttcctctgcccagtctctgccctttcccagggggtagaactccttccctctgggccctggtac

SEQ ID NO: 332085 - DNA, 337 bp, Homo sapiens
gatgacctcataaataattttggaaccattgccaagtctccaagattgagcagtttggtttttagcctgcctacctggtggcacagaaagtgactgtgatcacacatcacaatgctgatgaacagtatgcctgagagtcttcctccactgtatgtgctgaccacagtgagcccaccagcagggataccaaagtgatcctccaccttaaggaagaccagatagagtacttagaagagagacaaatcaaagaagtagtgaagaagtactcatagttcataagctatcccatcactctttatttgggggaaggaatgagagaaggaaaccggtgacaatg

SEQ ID NO: 332086 - DNA, 195 bp, Homo sapiens
cccaactgggctcagatcccagaaaagcagaggcctgtccaggcctgagctggggctgggaggactcccaggtggtagtcagttccccattcctggggcttatcccagaaaccaaatcaacacagtccatctgggtgttcccggaggcgtgtttaagaaggcggcccggcctggttggggttattggggggggtc

SEQ ID NO: 332087 - DNA, 459 bp, Homo sapiens
tccttagttactgctacatacatgaccacatgaccagaatgcagatcaaagtgtctctgagccctacagagctctctggtgtgatggtctggcctcctgcctctgcctggcaccccctctgcccacccatccctgtcccatagctgtgcagtgcccaactctacagggaacacactatgaaagggcttagttatggggcagtgggggtttcatggctaagcctttaaggttcctccaccctagcaagtgtggggaaggagaaaactaccctaggatgttgagtaccaatgtggagaatacaagactgcagaggctcccatcccaggaggtggcgatgacattacatttccgggtttggaacaggaaggctcatggtgtgggcggcatgagagctagtccatgagtcaggcagagaatgtttacacgtggtggtaagaaaagcagcattccaggaatact

SEQ ID NO: 332088 - DNA, 468 bp, Homo sapiens
tctctagtcaggctaatcaagcaaaaaagaaagaagacaaactactaacatcagaaatgaaaggcaggccttcagtactgtttctatgaaaattaaaagataattgagggatagtatgagcaactctagtccaacaaatttgataacttagatgaaatggacaaattccttaaaagatcccttcctatagaagatacattgataaattgaattggtctgtatctattaaataaattgattcaataattaataaccttccaaaacagaaagcactggtccaaatggtttcactggtgaattttactaactacttaaagaagaaatgatgtgaattctctataatttcttccagaaaacagaagtagagggaatacttcctcattccatgaaaacagcaccattctaatatcaaaaccaaagacattacaagaaaactacagaccaccctctttcctgaatatagataca

SEQ ID NO: 332089 - DNA, 784 bp, Homo sapiens
  misc_feature (767)..(767): n is a, c, g, or t
  misc_feature (772)..(773): n is a, c, g, or t
  misc_feature (775)..(775): n is a, c, g, or t
  misc_feature (779)..(779): n is a, c, g, or t
  misc_feature (783)..(783): n is a, c, g, or t
ttctgtatctcaggatttctgactctaaaacccacgctctgttctgtcatctgtagcaccaccttgctctcaccagtcatcagaagggcaccaaggactaaaatggtccagggaggctgcttctgccctgagtgaggaggtgcccttctggccctgctgcatcacactcaaggatcatttagagggcacatgtgtccagtggctctccctattgtaaatatttcagtaaagagttaaaacaagagacattgttatgtgtggggaaatgtatagtgttctgcttttctcctgattgggttatcttgcctctgctaagtttggtttgtcccgtctctatctcagtggccactggagagagggtgtctgctgttcttccctgattccacctgtaaatacaaacgttatctcttctccctggctttgctctgtgcatttgaggtgggaatgtactcggtttggcgaaatagtctttcatgtccctaaacctgaagcctctattgactgtaaatggtagagaaaaggaaagtacccccaaggtgtgaactctagttagggaaaaaaatatttttgggcttgacagtgactcttagttaactcaattactggaataatagagtcagaaatatttctttgtttttcagggaggtagaggcaggagcgtaagatgtggaagctagaaatatccacttgtaacacggtattagaaggaatgttattttacatggaagataatcctcagtgatccttttttttttttcttcaagacngagtnntnctcngtcnc

SEQ ID NO: 332090 - DNA, 538 bp, Homo sapiens
cctatggtctccttattcatcaaagggcctacccattttctcacaagtgggcactcaatgtatatctgtggaatgcatgtatgaccaaagaggaagagtccacagaatgaaacgggagctcacatttgagtgtggtacaagtcacccggagcaatgaaagaccaccacagactggggtgtcagagtcagctacctttaaaaggcaaatacaggataaaagtttagaatgattcctggctccaaaacactgccttcagtctaatctaagattttaataaaaacatatttacgcctatgaaataataaaacatataacttttaggcaaatataagactaacaaaaacatacctacatatgtaaaattctagacttcaccttaggtaaagtcctaaaataacttcttcaaatttcctttgcctaatgaggatatggcccaggactagtactctgggatgctgattcaattcctacatttgctattatttggaattggcacattttattaatgatttaggtgacaagtacttgaaaaattag

SEQ ID NO: 332091 - DNA, 418 bp, Homo sapiens
atcaatggcaaatatcaatatttctcctacatttcaaaaagtagctgattattttctcaaaaattactgttaaaatataaatttcaaaaaagaaaattatgagtttcatacagatgtaaaattaacaagtgttaaagattttacttaaatcattaaagaaggaactagtaaggtgttataaccagttcaaaggagagtttaaaaacatacatatttttagttcaggaatattgaaatagatgtacaaagggaggcaaaacggactttttcacagtgggaagtcagttatactcagagtttgcatgtctatagataaaagtaattttgtttttctattaattatctacaacttacacagttataaaacagctctcaaagaatcagaatcagatacataggaaagatgtactgtagacaa

SEQ ID NO: 332092 - DNA, 2080 bp, Homo sapiens
gcaaagaaatattatagaggtttttttttcattccaagttttaagttgtccttgtgcatgaaatatgcacatgataaaaagggggttgccatcaatgcatattgtcttgaaaagccaagggctctttttcggtttttctctataatgaagactgttagactgaggactctataattatgctcactgaacaaataccttgaaagggaagtaattccaagtcatgtatcaaagattcaatttgacatgtatttactaaatgcctaacatgcctatgcattttgtttattcatttatagtaacaagatatagtgagttcatattctgtgccagcactgtgctcagtattgaaaaattggagtcacaagattcccactttcaagaacttacagtccaatggaggagaaagaagtatgaaaggatcaattgcagggtgacaagagagtgttccaatagtgcagatccagagctgtgattttaaaaagatgatgcaaaccagttatctcttgcttcatggagtggatgggctacaggaaatttgacaataaaacaaagcttaaataaattgcaacatttgtctacaactctactgtaaaattggaaatgcttttccacagaaaaacctctcaaaatgctgaatgcaaaagttgggatcacagaaacattgtgcctatttttggtctgctggaaactgtatttttacaaggtaatccctgttttcaatatagttcctgtcttgccactggcggttttcttgtagcatttttctagttctgagattgctactacccaaagtattcatttctttcttactggggtgtcctctgtcttcacagcctgcttctggattgtaggttttttcctttctttctgttgagatatttatggcatttgatagagtcaaaccagatgtattgcagccggacatacttatgtggcttcagatgtgtaaaataagtaacttcctatctttgtctgtctagctcaagagttgactgtggacgaggaatgcctgtattgattcattaatgtaataactatttactgactgcctaccatgtacaaccagaaacacagttcctaacctcatgaacttaccatgtaacatgggaagacaagcactaagttcttatttgtttgtaattgtgataaggctcagagaacaaatacagattcctatgaacccatgtatagggggaaatatttaggttccatttaatactgacatggctaagtatctcagtatttaagctgagatctgaaggataattagaagattcctcaggcagagggaagagcaaaggctgtgtgtggggcaggaagaaatgtggtcgtttgaggaacttcgagatcagcgtggccactgatgtgctgcagtgtagcaaagagagcaaaagaaagagagaaacagggaggaatggaattcagctcacgggctctggaatcagagtttcaagttggaatcctgacttcctagctgtatcggttaagaatttttttttgtggcatccaaagaacagaaagcctaccttactgaggttcatataaaaaggggaaattggccaggtgcggtgggtcacacctgtaatcccactactttgggaggccgaggcgggtggatcacctgaggtcaggagttcgagaccagcctggccacagtggtgaaaccccgtctctactaaaaatacagaaattagctgggtgtggtggcgggcgcttgtaatcccagctactcgggaagctgagggaggagaatcgcttgaacccgggaggcagaggttgcagtaagccaagatcgcgccattgcacttcagcctgggcaacaagagcaaaactctgtctcaaaaaaaaaaaaaaaaaaaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatg

SEQ ID NO: 332093 - DNA, 1988 bp, Homo sapiens
  misc_feature (1772)..(1772): n is a, c, g, or t
  misc_feature (1907)..(1907): n is a, c, g, or t
tgagatcagaggcaagaaagttgaggatgtggtacaatgattatcaagcataaagtccttcatcgatggcagccaccaaggcctgtgttcattgcaaatcacaggatttttcccttgaaccataattggacaaaattgcacaggttttcctctctggagcagacaagatggagacaaattcctctctccccacgaacacctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggcgttacaggcaaagtgaggagggagctgggggacactttcgagctcccagctccagcttcgtctcaccttgagttaggctgagccacaggcatttcctgcttattttaggattacccactcatcagaaaaaaaaaaaagcctttgtgtcccctgatttggggagaataaacagatatgagtttattattgacttcttttttgattttggacctcagcctcgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggaggccgaggcaggcggatcaccagnggtcaggaattcgagaacagcctggccaacatggtgaaaccctgtctctactaaaaatacaaaaattagctgggcgtagtggcaggctcccgtaatcccagctactcaggagaccgaggcaggagaatcgcttgnacctggaaggcggaggttgtagtgagccaagaaaacgccactacactccagcctgggtgacagagagagactccggctcag

SEQ ID NO: 332094 - DNA, 1261 bp, Homo sapiens
  misc_feature (1235)..(1235): n is a, c, g, or t
tctccccaggagacccagacctagaactacccagagcaagaccacagctggtgaacagtccaggagcagacaagatggagacaaattcctctctccccacgaacacctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggcgttacaggcaaagtgaggagggagctgggggacactttcgagctcccagctccagcttcgtctcaccttgagttatggtctggaagcaaaaaacaagggcatgtgtggcgctggcctttatctntttatgagcttatccccaactgtctc

SEQ ID NO: 332095 - DNA, 1895 bp, Homo sapiens
  misc_feature (1679)..(1679): n is a, c, g, or t
  misc_feature (1814)..(1814): n is a, c, g, or t
tctccccaggagacccagacctagaactacccagagcaagaccacagctggtgaacagtccaggagcagacaagatggagacaaattcctctctccccacgaacacctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggcgttacaggcaaagtgaggagggagctgggggacactttcgagctcccagctccagcttcgtctcaccttgagttaggctgagccacaggcatttcctgcttattttaggattacccactcatcagaaaaaaaaaaaagcctttgtgtcccctgatttggggagaataaacagatatgagtttattattgacttcttttttgattttggacctcagcctcgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggaggccgaggcaggcggatcaccagnggtcaggaattcgagaacagcctggccaacatggtgaaaccctgtctctactaaaaatacaaaaattagctgggcgtagtggcaggctcccgtaatcccagctactcaggagaccgaggcaggagaatcgcttgnacctggaaggcggaggttgtagtgagccaagaaaacgccactacactccagcctgggtgacagagagagactccggctcag

SEQ ID NO: 332096 - DNA, 1299 bp, Homo sapiens
  misc_feature (1113)..(1113): n is a, c, g, or t
  misc_feature (1124)..(1124): n is a, c, g, or t
  misc_feature (1128)..(1128): n is a, c, g, or t
  misc_feature (1134)..(1134): n is a, c, g, or t
  misc_feature (1136)..(1136): n is a, c, g, or t
  misc_feature (1142)..(1143): n is a, c, g, or t
  misc_feature (1148)..(1148): n is a, c, g, or t
  misc_feature (1156)..(1158): n is a, c, g, or t
  misc_feature (1164)..(1164): n is a, c, g, or t
  misc_feature (1173)..(1173): n is a, c, g, or t
  misc_feature (1176)..(1176): n is a, c, g, or t
  misc_feature (1181)..(1182): n is a, c, g, or t
  misc_feature (1185)..(1185): n is a, c, g, or t
  misc_feature (1196)..(1196): n is a, c, g, or t
  misc_feature (1200)..(1200): n is a, c, g, or t
  misc_feature (1202)..(1202): n is a, c, g, or t
  misc_feature (1216)..(1216): n is a, c, g, or t
  misc_feature (1226)..(1226): n is a, c, g, or t
  misc_feature (1229)..(1229): n is a, c, g, or t
  misc_feature (1232)..(1232): n is a, c, g, or t
  misc_feature (1236)..(1236): n is a, c, g, or t
  misc_feature (1238)..(1238): n is a, c, g, or t
  misc_feature (1241)..(1241): n is a, c, g, or t
  misc_feature (1256)..(1256): n is a, c, g, or t
tctccccaggagacccagacctagaactacccagagcaagaccacagctggtgaacagtccaggagcagacaagatggagacaaattcctctctccccacgaacacctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagagtgcgtanagcaagtgagnggantggggnanttcgannccacncagctcgnnnacttantagctacanagnattcnnctntttagataccntcananaaaaaaaaaccttnttcctgattnggnganaaanantanttaaaaaaaaaaaanttttttttttttttttttttttttttttttttttttttttttt

SEQ ID NO: 332097 - DNA, 379 bp, Homo sapiens
tttcagttcaactaattgtttaattttcctcttgatttcattgttaacctagagatcattcagtagcagattaatttccatgtgtttgtatagtttttagggttccttttggagttgatttctaattttattccactgtgatctgagagagtgcttaatataattttgattttcttaaatttatttagacttgttttgtggcctatcatagggtctatcttgaagaatgttccatatgctgatgaaaagaatgtatgttctgcagttgttgggtagaatgttctgtaaatatttgttaagtccatttgttctagaatatagtttaagtccattgtttcttggttgacttccttgatgacttctctagtgctgtcagtgg

SEQ ID NO: 332098 - DNA, 949 bp, Homo sapiens
  misc_feature (845)..(845): n is a, c, g, or t
aaccccccaccggagtagtcaggtacaggccttggtttggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggtgnagtcttgcccacataatgcgcttcgcgcgttccattgatgtggccggccgtatttaggtttccacacgtgctgtccgcatattatggctcactgggggtcccgg

SEQ ID NO: 332099 - DNA, 408 bp, Homo sapiens
ccaaggctttccaccttgaaccttggtgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332100 - DNA, 1270 bp, Homo sapiens
aaccccccaccggagtagtcaggtacaggccttggtttggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332101 - DNA, 1266 bp, Homo sapiens
agctagtcgaggcggcgtgatcggccgaggcggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332102 - DNA, 1437 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaaaaaaaacctctttgattggggaatgaagttgggaaagtcactagcattttccttggatccagtcctgtcagcatgatgcctccatgaataagagtgaacttcttgtaaagtgaaacta

SEQ ID NO: 332103 - DNA, 1743 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggttagagctctctgaggacccagcacagagcactggtgccagggaccaaactgagaccccaccaccgtcatcaacacttacataccataaaggtcttcagagtgccttggccctagacctcccttcgttctttgtagagatggaatctaagaatgaaacatctccactcagtcctgcaaatatggaagttcttgagatacctttttttggtagatacttgtgctggtattctgagagtcactttactctgatggtttgcaagattcctaaaatcaactccagagcttacaagacaggtttgagagagggagaaaggaaaaccaacttactggcccccatgccatcttttcccgtttagccattggtaggctgggctgcacctctgtcaagtgtcctcatggtattctctctgttcctctcctcagccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332104 - DNA, 1496 bp, Homo sapiens
gcgcgcagcgcaaactaaggctagtagagccgggggttagtcgctgcggcggtgggaaatgctggcgcgcgcggcgcggggcactggggcccttttgctgagggtgagagcgaggcaacctttccagagggtcaggacagagattacctgggttctccgctggaaaagagcgaaattccaacttttggagaggactggggtcagaggtcatggtccccatgtgattctccgaggatcctgagggtcgtggtttatggagatgccttcaggaccgaggggcggcgtgtctggccagatgggatctctgctcaccctcttctttccttcagggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332105 - DNA, 1229 bp, Homo sapiens
agtgaccttgagattacccgccccctcccggattatcgggatccgctccgctcgtctcgttggttccggaggtcgctgcggcggtgggaaatggccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332106 - DNA, 1642 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacatgtgagaggcccctgggtgggaatggggacaggaattgacagtggaaggggttctcttatctacgcttgaggagagttccgcctctgtgggctctgttgagccagattacatggtcctttttattgtgaactgctttcttcattccccatcccccccttcttctccgtatcggtgatctctgatttttatccccctgtgatcacagaatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaaaaaaaacctctttgattggggaatgaagttgggaaagtcactagcattttccttggatccagtcctgtcagcatgatgcctccatgaataagagtgaacttcttgtaaagtgaaacta

SEQ ID NO: 332107 - DNA, 1794 bp, Homo sapiens
agtgaccttgagattacccgccccctcccggattatcgggatccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagccttgtgagaaacctcttctgcccaccctgggccagccagatgaccaatccctcacgacatgcaatgtcgggaggacttcctttgggcctgcccgcactgttagctcccgactctgtaggccagacctgacagggcccaggctgctgaccatcatccccatgttaccaccttttcctatgcatctcacaggccccattcttgggaatctcccctgcccactctcagccctacctctcagtctgcatagagatggctattctgctggctccgattctcatgactctcccctccattcaggggcctagtcttgcattcctgttctcttgggttttcttaccagtgacacctcagccttctgaggacttatttcttggtaggagctgctgcttttctgggcatgttccatgtgttgactccctacatactccaggactagcttaggtcccaacccaatagttcccagccttctgaggacccatgactcctctttccagggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332108 - DNA, 1948 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacatgtgagaggcccctgggtgggaatggggacaggaattgacagtggaaggggttctcttatctacgcttgaggagagttccgcctctgtgggctctgttgagccagattacatggtcctttttattgtgaactgctttcttcattccccatcccccccttcttctccgtatcggtgatctctgatttttatccccctgtgatcacagaatggagatgcagcagcttcactgactgtggccgagcagtatgtcagcgcgttctccaaactggccaaggactccaacactatcctactgccctccaaccctggcgatgtcaccagcatggtggctcaggttagagctctctgaggacccagcacagagcactggtgccagggaccaaactgagaccccaccaccgtcatcaacacttacataccataaaggtcttcagagtgccttggccctagacctcccttcgttctttgtagagatggaatctaagaatgaaacatctccactcagtcctgcaaatatggaagttcttgagatacctttttttggtagatacttgtgctggtattctgagagtcactttactctgatggtttgcaagattcctaaaatcaactccagagcttacaagacaggtttgagagagggagaaaggaaaaccaacttactggcccccatgccatcttttcccgtttagccattggtaggctgggctgcacctctgtcaagtgtcctcatggtattctctctgttcctctcctcagccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332109 - DNA, 1827 bp, Homo sapiens
gcgcgcagcgcaaactaaggctagtagagccgggggttagtcgctgcggcggtgggaaatgctggcgcgcgcggcgcggggcactggggcccttttgctgagggtgagagcgaggcaacctttccagagggtcaggacagagattacctgggttctccgctggaaaagagcgaaattccaacttttggagaggactggggtcagaggtcatggtccccatgtgattctccgaggatcctgagggtcgtggtttatggagatgccttcaggaccgaggggcggcgtgtctggccagatgggatctctgctcaccctcttctttccttcagggctctctactggcttctggccgcgctccgcgccgcgcctcctctggattgccccgaaacaccgtggtactgttcgtgccgcagcaggaggcctgggtggtggagcgaatgggccgattccaccggatcctggagccttgtgagaaacctcttctgcccaccctgggccagccagatgaccaatccctcacgacatgcaatgtcgggaggacttcctttgggcctgcccgcactgttagctcccgactctgtaggccagacctgacagggcccaggctgctgaccatcatccccatgttaccaccttttcctatgcatctcacaggccccattcttgggaatctcccctgcccactctcagccctacctctcagtctgcatagagatggctattctgctggctccgattctcatgactctcccctccattcaggggcctagtcttgcattcctgttctcttgggttttcttaccagtgacacctcagccttctgaggacttatttcttggtaggagctgctgcttttctgggcatgttccatgtgttgactccctacatactccaggactagcttaggtcccaacccaatagttcccagccttctgaggacccatgactcctctttccagggtttgaacatcctcatccctgtgttagaccggatccgatatgtgcagagtctcaaggaaattgtcatcaacgtgcctgagcagtcggctgtgactctcggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332110 - DNA, 1168 bp, Homo sapiens
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332111 - DNA, 1086 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaagcaggttaagctgagtatcgatctggtgagtctgacacactaagggatgcgcgttcctgatgtgccaccgatgcggcgttccaatggcaggtcaatttctttgccccactggggtcccgatgtgtcggccgtgtttggccccaaccaggggggaacaattccggggatgtcgccagcttgaagctaactatcggcgacggaacctctctccccgtttgtgccccaaatgc

SEQ ID NO: 332112 - DNA, 1159 bp, Homo sapiens
agtgaccttgagattacccgccccctcccggattatcgggatccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaaaaaaaaaaaaaaaaaaacacaatggtgggcggggcccggggccccgggaagcgttttaaaaacaaatcgggggggggccgggggcccagtgggggaaagggaaatggggcaaaaccggggccaaagggagacccgggggcaagagaaaaggggggggggttctctcccacaattaaaaaaccccgggggggggacaccgggcgggtctgggaaaaattccaaaaggggaggccgggagggcccaaaagggggatctataccaaacggggagccaaaggggacccccggatcaaattaaacgccgggcgggtgc

SEQ ID NO: 332113 - DNA, 996 bp, Homo sapiens
agtgaccttgagattacccgccccctcccggattatcgggatccgctccgctcgtctcgttggttccggaggtcgctgcggcggtgggaaatggccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaagcaggttaagctgagtatcgatctggtgagtctgacacactaagggatgcgcgttcctgatgtgccaccgatgcggcgttccaatggcaggtcaatttctttgccccactggggtcccgatgtgtcggccgtgtttggccccaaccaggggggaacaattccggggatgtcgccagcttgaagctaactatcggcgacggaacctctctccccgtttgtgccccaaatgc

SEQ ID NO: 332114 - DNA, 923 bp, Homo sapiens
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggtaagcagatctgagccagagttagggtttgaagacacaaacctgacactcttaatcttttctgaaggtcaagatcagtcccaggcccttctcagtgtaggcccttgataggtaggttgaggctgtggggcttacacctctttttccaggaacgggagtccctgaatgccagcattgtggatgccatcaaccaagctgctgactgctggggtatccgctgcctccgttatgagatcaaggatatccatgtgccaccccgggtgaaagagtctatgcagatgcaggtgggggccaaggaggggtgggaaaagggcctcagggctccagtaccaggaggatccagacttccctcctgttatgatgggtagagttgcatgttgtatcagtctcccttggcttgttgattgggattgttgtgggc

SEQ ID NO: 332115 - DNA, 801 bp, Homo sapiens
  misc_feature (245)..(245): n is a, c, g, or t
  misc_feature (252)..(252): n is a, c, g, or t
  misc_feature (255)..(256): n is a, c, g, or t
  misc_feature (258)..(258): n is a, c, g, or t
  misc_feature (261)..(263): n is a, c, g, or t
  misc_feature (265)..(265): n is a, c, g, or t
  misc_feature (271)..(271): n is a, c, g, or t
  misc_feature (273)..(276): n is a, c, g, or t
  misc_feature (279)..(281): n is a, c, g, or t
  misc_feature (286)..(286): n is a, c, g, or t
  misc_feature (288)..(288): n is a, c, g, or t
  misc_feature (293)..(293): n is a, c, g, or t
  misc_feature (297)..(297): n is a, c, g, or t
  misc_feature (300)..(301): n is a, c, g, or t
  misc_feature (307)..(307): n is a, c, g, or t
  misc_feature (318)..(318): n is a, c, g, or t
  misc_feature (320)..(320): n is a, c, g, or t
  misc_feature (324)..(324): n is a, c, g, or t
  misc_feature (334)..(334): n is a, c, g, or t
  misc_feature (342)..(342): n is a, c, g, or t
  misc_feature (349)..(349): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (363)..(364): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (381)..(381): n is a, c, g, or t
  misc_feature (384)..(384): n is a, c, g, or t
  misc_feature (404)..(404): n is a, c, g, or t
  misc_feature (411)..(411): n is a, c, g, or t
  misc_feature (415)..(415): n is a, c, g, or t
  misc_feature (417)..(417): n is a, c, g, or t
  misc_feature (435)..(435): n is a, c, g, or t
  misc_feature (441)..(442): n is a, c, g, or t
  misc_feature (451)..(451): n is a, c, g, or t
  misc_feature (483)..(483): n is a, c, g, or t
  misc_feature (487)..(487): n is a, c, g, or t
  misc_feature (489)..(489): n is a, c, g, or t
  misc_feature (502)..(502): n is a, c, g, or t
  misc_feature (534)..(534): n is a, c, g, or t
  misc_feature (607)..(607): n is a, c, g, or t
  misc_feature (657)..(657): n is a, c, g, or t
  misc_feature (792)..(792): n is a, c, g, or t
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctatgntttgaanatnntnatnnntntgttanannnnatnnnatatntncacantctnaannaaattnttataaaactncnttancactcccctntgaatatncaaaatntaantntncaaatnnatncanttntttaaatnccnataatccaaaattaaaaccnaacctancctntncaccaaaatcactatccnctcaannacctacctnaaaaaaaaatcacataacacctacccaaaatntatntncaaaaactattcncccaaacccacttaatcaatcaaacaattgtncatcaaataaaaaaacatcatcaatcatcccctataacatcaataacttatcacataaaccatataaatgttnaaaaaaccctcaaacactttatcaacatcaacctccaccaacacaccacnaaaacccaaaaacttatacactatcacccccaaaacacactaccaaataaatctcccacaacccaacaaaaaccaaaacataatccaataacaacaacaaaaccatcaaaacataaataaccaacaaccacaccnaactcaact

SEQ ID NO: 332116 - DNA, 742 bp, Homo sapiens
tggccgtacgcttgacgttggagtgttaattaacgaatttggttagtaaccgtcagtccgctacgatttcgccaagctcgaaagccggacggatccccagggctgcagagtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332117 - DNA, 1319 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332118 - DNA, 1270 bp, Homo sapiens
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332119 - DNA, 1632 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaaaaaaaaaaaaaaaaaaacacaatggtgggcggggcccggggccccgggaagcgttttaaaaacaaatcgggggggggccgggggcccagtgggggaaagggaaatggggcaaaaccggggccaaagggagacccgggggcaagagaaaaggggggggggttctctcccacaattaaaaaaccccgggggggggacaccgggcgggtctgggaaaaattccaaaaggggaggccgggagggcccaaaagggggatctataccaaacggggagccaaaggggacccccggatcaaattaaacgccgggcgggtgc

SEQ ID NO: 332120 - DNA, 1208 bp, Homo sapiens
agtacatccgggggagcggaactgcaagaggaaaggctcggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332121 - DNA, 1524 bp, Homo sapiens
agtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacatgtgagaggcccctgggtgggaatggggacaggaattgacagtggaaggggttctcttatctacgcttgaggagagttccgcctctgtgggctctgttgagccagattacatggtcctttttattgtgaactgctttcttcattccccatcccccccttcttctccgtatcggtgatctctgatttttatccccctgtgatcacagaatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332122 - DNA, 1988 bp, Homo sapiens
gcgcgcagcgcaaactaaggctagtagagccgggggttagtcgctgcggcggtgggaaatgctggcgcgcgcggcgcggggcactggggcccttttgctgagggtgagagcgaggcaacctttccagagggtcaggacagagattacctgggttctccgctggaaaagagcgaaattccaacttttggagaggactggggtcagaggtcatggtccccatgtgattctccgaggatcctgagggtcgtggtttatggagatgccttcaggaccgaggggcggcgtgtctggccagatgggatctctgctcaccctcttctttccttcagggctctctactggcttctggccgcgctccgcgccgcgcctcctctggattgccccgaaacaccgtggtactgttcgtgccgcagcaggaggcctgggtggtggagcgaatgggccgattccaccggatcctggagccttgtgagaaacctcttctgcccaccctgggccagccagatgaccaatccctcacgacatgcaatgtcgggaggacttcctttgggcctgcccgcactgttagctcccgactctgtaggccagacctgacagggcccaggctgctgaccatcatccccatgttaccaccttttcctatgcatctcacaggccccattcttgggaatctcccctgcccactctcagccctacctctcagtctgcatagagatggctattctgctggctccgattctcatgactctcccctccattcaggggcctagtcttgcattcctgttctcttgggttttcttaccagtgacacctcagccttctgaggacttatttcttggtaggagctgctgcttttctgggcatgttccatgtgttgactccctacatactccaggactagcttaggtcccaacccaatagttcccagccttctgaggacccatgactcctctttccagggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332123 - DNA, 1132 bp, Homo sapiens
gcgcgcagcgcaaactaaggctagtagagccgggggttagtcgctgcggcggtgggaaatgctggcgcgcgcggcgcggggcactggggcccttttgctgaggggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332124 - DNA, 1419 bp, Homo sapiens
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggtaagcagatctgagccagagttagggtttgaagacacaaacctgacactcttaatcttttctgaaggtcaagatcagtcccaggcccttctcagtgtaggcccttgataggtaggttgaggctgtggggcttacacctctttttccaggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332125 - DNA, 698 bp, Homo sapiens
  misc_feature (58)..(58): n is a, c, g, or t
aggaggaatccccgcaacggcatggacgcggctccgggtgaaagaggtctaagcaagnatgcacggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332126 - DNA, 605 bp, Homo sapiens
gaagaaggccaaggggaaggcggggtggaggggtgtctaaggaggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332127 - DNA, 715 bp, Homo sapiens
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaa

SEQ ID NO: 332128 - DNA, 578 bp, Homo sapiens
gcgcgcagcgcaaactaaggctagtagagccgggggttagtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctccaaaacaaactctctcttggggaccaagagtcccctttttttccccacaccccacggggggcaaggacacagacgggaccacaaaatacaaaacc

SEQ ID NO: 332129 - DNA, 1590 bp, Homo sapiens
acaacagttaagcactctttgactgctgaaggaaccccatggatgaggtgcaggctacttcactctttttttttcttttttgagacagagtctcacctattgcccagactgaagtgcagtggtgcgatcatggatcactgcagcagcatcctccgagttcaagctatccttccacctccgcctcctgagtagctgggaccacaggttcacataaccatgcctggctaatttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgtgtgtgtgtcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatatatggttgaagaatcaaaacaaaagcaaaaaaaaaaaaagcaaaaaaagaaaagagaaaaaaagaaaaaatgcaaatggaataattttctattatattttagacaaacatatcattttcgagtattttaaatactgaattcatagttgttgttttttaaattccaacagtaacagctgaatggtttaatctgactggcttcctaagaaatgtttaagactcagctttaaaaagaagttaacattcatatctctgttttgaaatcaaaaatcatatttcaaaattctttcctaggaccatctatgtgtctcccctcccctccacaaaaaggagaaagagtgcattaaaatgtttagttgggttttttaatttttaatttttatgttatgttttgctttgttttaagtaaacaaaaatttttctttctttactgcatgcatagcacttaataaaatggatttttaaaaaatccactagtaatatcagaatgtccagggagtgactgtcactacaatgatggtttagtttacttctgttccaccttttgattgaaatatttagttgttaggctgaaagcctcggcagttaagaacttgcctgagttttcttcgttcagcaacttgacagtttgactgatgtgcattatatatagctcaattatgtctgttttttatgctaagtaggaaaaccaaccaca

SEQ ID NO: 332130 - DNA, 1684 bp, Homo sapiens
agatcatgcggagaacccatggtcagaaacaatctgggcaaaaaagaggcaggcatttcaaaggaaggggcaaggaagacgtggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgtgtgtgtgtcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatatatggttgaagaatcaaaacaaaagcaaaaaaaaaaaaagcaaaaaaagaaaagagaaaaaaagaaaaaatgcaaatggaataattttctattatattttagacaaacatatcattttcgagtattttaaatactgaattcatagttgttgttttttaaattccaacagtaacagctgaatggtttaatctgactggcttcctaagaaatgtttaagactcagctttaaaaagaagttaacattcatatctctgttttgaaatcaaaaatcatatttcaaaattctttcctaggaccatctatgtgtctcccctcccctccacaaaaaggagaaagagtgcattaaaatgtttagttgggttttttaatttttaatttttatgttatgttttgctttgttttaagtaaacaaaaatttttctttctttactgcatgcatagcacttaataaaatggatttttaaaaaatccactagtaatatcagaatgtccagggagtgactgtcactacaatgatggtttagtttacttctgttccaccttttgattgaaatatttagttgttaggctgaaagcctcggcagttaagaacttgcctgagttttcttcgttcagcaacttgacagtttgactgatgtgcattatatatagctcaattatgtctgttttttatgctaagtaggaaaaccaaccaca

SEQ ID NO: 332131 - DNA, 1439 bp, Homo sapiens
acaacagttaagcactctttgactgctgaaggaaccccatggatgaggtgcaggctacttcactctttttttttcttttttgagacagagtctcacctattgcccagactgaagtgcagtggtgcgatcatggatcactgcagcagcatcctccgagttcaagctatccttccacctccgcctcctgagtagctgggaccacaggttcacataaccatgcctggctaatttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgtgtgtgtgtcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatatatggttgaagaatcaaaacaaaagcaaaaaaaaaaaaagcaaaaaaagaaaagagaaaaaaagaaaaaatgcaaatggaataattttctattatattttagacaaacatatcattttcgagtattttaaatactgaattcatagttgttgttttttaaattccaacagtaacagctgaatggtttaatctgactggcttcctaagaaatgtttaagactcagctttaaaaagaagttaacattcatatctctgttttgaaatcaaaaatcatatttcaaaattctttcctaggaccatctatgtgtctcccctcccctccacaaaaaggagaaagagtgcattaaaatgtttagttgggttttttaattttttttgcgctgctaagaagctaaagtcatccatccttattcacgttgacagtacctagctgtaatgtttcacagagtgtgctgctattttataaacatttttataatatattattttactgcttaaattccaagtcctgaagtagatgtgagatatgagagtctccgtcgaact

SEQ ID NO: 332132 - DNA, 400 bp, Homo sapiens
tgagctgagatcgaaccaccacacttcagcttgggcaacagagcaaaacaacaacaaaaaagtaggagctaacatacagctggtgtttcaggccacatctgtgcattttatttcaaggacaaaaggaaacccaagtcatcactagggcaaaggcaaaccctctgtgatctgcacccaactctccaattctcctcatgtgctgggccttctgcctagagctcccctccctcttctcttcacacaccggctccttctctcctggtctcagcccagatgtggcctcctcagtggcaccttccatgaccacctaccccaaggaccctctcctccctagggttccaggggatggctgtctgccctgtttccttcctttagctttttttttttttttttttttttt

SEQ ID NO: 332133 - DNA, 860 bp, Homo sapiens
ccttggctgttatgaggaaaaatctgagtctataggagtcagtttgttttcactaaatgagcttgaagcatgacttgtgttaatcctaataagccggtgattaggtaaacatgctgttaaatgcaaaggaatgcaaggaatttcaactacttttccaatagcgtgagggccaagctaccccatccccctttcctttttataatatacgttatattgatgggggagggagcagttatatagagttggctattcagaaggtcaaaggtccagagcattcctaaaagaaagggacccaaatcataggtctaggagaggttgagaaggctgtgtcaatgtttgtgaaaatgtcagtagtctgtttcagaagcatcttcatctttagaaagcgctgacaataaaccttttatagggagaagttttcctttcatcatcactgttggctcctgttcaaatccatagtgaaatatttcagtccgcacttagttaagagagtacttgagtttttaggcagaagagaaagtgcttttaaaaggaatggaggaggacagctcctgggatcctgaagggatttttccaagtagattaaataagatccatactttaatgaagacccacagaaaaatactgcctaagaaatggttttaaagccttatggaaatgcatagaggttaatataaatgcactagtaaaatctatggccaaaagccttcacttctgattttgacttgcctgaaatattacagcttgtgccttctgaatagtcaggtttcttgcctgagacattcaaatgttaaggtatttgagaatttaaacatcagctggcccagtcgtggatgcagttaaacttgtcagtgcaatgt

SEQ ID NO: 332134 - DNA, 191 bp, Homo sapiens
cggcctatattttttatttttatttttaagagagacaaggtctttctgtgttgcccaggctggtctcaaactcctgagctcaagcaatcctcctaccttggctaaagaaagtcatttgtgtaagtaactatagtctgagaaataaagttattacatgtaatagtttttcttttttcttttttttttttttt

SEQ ID NO: 332135 - DNA, 507 bp, Homo sapiens
gcagagcagggagaggtcctgcctaaaccaccagagatgccaagatggccaagtgcccggcaacagtggaggggcaacggcagcttagaaaatggctagaagacaacaagggggtgtaaggggagaggagagacagagaatgaggtttctgggatgtggggcccataggcctgctatgacccagccggaccacctgtctgggcaagtacagagcaccaggcctcactttcacagaaaggccccaaagctttattgacggctacatgtggtcccttcctctgtccagccaaaatcacctgaagttcttgctaaaggagactccctaggttcagggaaaggaagacctctgctagagccaggggaaatctgaggccaaggtgcttcaggtaaatgcccaccctgtcagtcagccagggaaagagaagaacaagcctactgctggtgccaaaccaggaaactggctgctccaagattctgtccctacaccaagaatttggggaaggcagc

SEQ ID NO: 332136 - DNA, 408 bp, Homo sapiens
aagggaacattacatcctctctaacaaaaataagctcggttgtctaggcgttttttaaaaagtctaccagatgactgagattgcaaggccctctagtgaaatgaaattcttcagagtgagagtaatgagtctatgaaatagggtggagagacaggacaaatgaactgtcttacttaaggcagttctgcaggaagaagagatgttcatggtaaaagcaggttaaaaaacagtggaaatgttaaccaattcttaaagatgtaggctagcatcatgtttagaatcccaggaagcctctaaaacaagggaagtctggaagtattacacaactcattaccatagtcctctgacaagcattcacaaggaagttttgtggtaggggaagaagcctgagaggaaaacccctccata

SEQ ID NO: 332137 - DNA, 2551 bp, Homo sapiens
gggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 332138 - DNA, 2116 bp, Homo sapiens
gtgacacgtctgggggaggggtagccgacaggcggcaggttagagtcccgatcttggccaggcctcagaagtgtgtgtggcctgggcaagcagcccccggtctcgtctgggggtctgcggggctagctttggctgcggtgaccccactccctccccagagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 332139 - DNA, 2173 bp, Homo sapiens
ctgtgtagggcatggacacagggagctcatggcagggctgacacagggtgtggtgggcacagggacaggaggcacgggaggcttcccgggatgtctgggaagtgttccaggccaaggctggggaggctggcccagggcaggtgacggacagaggcctggactggggtagcacccatgagaggggagaagtccggggcagtcggcgggtgccgaggagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 332140 - DNA, 1951 bp, Homo sapiens
gggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 332141 - DNA, 470 bp, Homo sapiens
  misc_feature (145)..(145): n is a, c, g, or t
  misc_feature (148)..(148): n is a, c, g, or t
gtggaaacctgggaaacacactcaaggtcctggggcgcttcgacgaggctgccgtctgctccagcggcatctgagcatcgcccaagagcagggagacaaggttggggaggcgagggccctctacaacatcgggaaacgtgtaccnacncaaaggcaagcaactgtcctggaacgccgcaaacgccacgcaggaccgccggcacctgccgcccgatgtccgagagaccctgtgcaaggcctccgagttctacgagaggaacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 332142 - DNA, 2088 bp, Homo sapiens
agcaggctggtactggtctgggagtatggatgggcggtggtggcctgggcaccttgtgtactgcctgcgctctgtgtggccaagcacccagcgtggctccctgctgctgtggagacagcctgtgatccgcagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 332143 - DNA, 647 bp, Homo sapiens
cccagagcgaggcaggccccagaaccaatttcctgggtggacagggggaagcccgtgaacagtgcacgctggcctctggaaccaccgctgctgaccagccccggaccactggggctgggggggtgaggccgccaactgcactgtgtccacccagtcctccaggatcgatgaccagcgctgcccaccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactccc

SEQ ID NO: 332144 - DNA, 159 bp, Homo sapiens
catgccatctctgaagaatattacagaccattttggagcatggtgaataagaaatttttaccttaggagttcacttgaatagtcatttttatatttgtgactgcaagtcacttttaggggctgtacttccttagtactggtagcattattatccaatgg

SEQ ID NO: 332145 - DNA, 306 bp, Homo sapiens
gaacctagtaaatactaattaattgttaatattatttaataaaatgacaggttttcaatgactagtaggactgacacacatattttgttttgctgtggctgattccagtgaagaagattcaaaatcttgagttctttaggatttgaaaaatagcaagagagcatcttgtcaactataaaacatcttcctaggctgggtgcggtggttcatgcctataatctcagcactttgggaggccgaggtgagaggatgtcttaagcccagaagttcaagaacagcctggacaatgaagtgagaccccatctc

SEQ ID NO: 332146 - DNA, 1966 bp, Homo sapiens
aattctaatcaatatttcatcattgctgtcaatgatagcctgttactaatgaaacaacattctgtcccagcactaaatttactgggacataaatttttcacatggagccaagctcttcactgattaagccaatgcagaatccacttgtgggcagtcagtgcccattaccccctgtgaaccattctgtgcccttgagtacatttgtgggtttaactcagtctatattcttaagttggtaatttttatgttgtaattctcaaagttctgtttctgtagctggactatgaataatacctgaatatgaagattgtgttttttaataatgtcaaagtggtgtgttgattatcataaatgttattaattcaaccccacagtttcttgggggctggttcctcattagagtgaaaggtagccaagagtgaaaactggaaggggcctaaggcttaaagtcttaagacctggatgtggttcaggttttgccatctgcctcagaaaaaatctcttcagttcttggagccttgaattcctcatctgttaaacaggaggaagaatatctacctcacaaagttcttatgagataatgaatataaaaatgtttcatccaggttgttgaatcatcccagcttatataataattacaaaggacatatgtactttaacaatggagaatgctgtgatttacctcttcaccgagtaacaaaatgtcacattgcttagattgagacagcccacataatgtgccaccttctgtgatgtaataagctgaaaaatgttcaacctgaatttaatcaagcttcttggacctcattgccaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatc

SEQ ID NO: 332147 - DNA, 899 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccggtgagcggggtgggctcgggggcgggtgggcgtgcagggaaggcggcccgggacgcgggcctgagcttgctgggactgcacagccctcggtagcctctcccgggccctgacccccggcatggtccgtcgccagcttcgtgttggggttcgacgtcgtggcctcggctgggcaggcagccggcccgagggaagtactgaggacagcagctccgagtctgtgtgtgtttgtggaccggtgctcctgtctaacggactctgctggcgctttgagaagagctgcctcagtagcctgctcccccagctcaggcctttctgctcttcctcagtcttgtctgaggctaatccacagaaacattctgaggtttccctattaccggtggcgcccagactcttgaggacggatttttttgtttgtttgttttaaggggtggaacgattttagcttttttagtcttttagttttgtaatataatggtatttaaaaatcaaacttgaaaaactcaaacttgaaaccacccataccaacattacttcaggcaatacattttaacacaaagtactaagaccgtaaactcagaataaatgctggcctttgcgcgcgcgcgcgcacacacacacacacacacacacacacacacacacactcattgccaacctgtcagcgacgattgttactggttttctctttttgcagcttaccagattaaagctttgtcgtggactggtgtttggaaactgttgttttagaacagtttgggttgtttgggtttcataag

SEQ ID NO: 332148 - DNA, 4606 bp, Homo sapiens
ccagagccttaggcagggggtttctgtcagaggaagcactctctagagcctggaaccttgcactcacaaaggttctctttattactgggagctgactgggagctgactggggcctggaaagctcagttgtttctctgggctaactttaacaatgatttcttgaggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtccctgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaagaggttatggtaaaagtttagaacatgggatcatgtaagtttgtgtattaagtcaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtata

SEQ ID NO: 332149 - DNA, 4689 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagtctggcttctgttcccaccgttgtgtacagtctcctctgggagaggtcaccagtgccatgagtggggctcgagggcagctccattgttctcaatgcaaagctttactgctgttttgatgctccatacttgaggttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtccctgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaagaggttatggtaaaagtttagaacatgggatcatgtaagtttgtgtattaagtcaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtata

SEQ ID NO: 332150 - DNA, 4627 bp, Homo sapiens
gtatatcaattaatggacttatgctcctaacagcccagccccaggacttggtgatgttcgaggaggtgtcagtatgcttcacttcagaggaatgggcatgtctgggcccaatccttagggccttgtactgggatgtgatgctggagaattatggaaatgtgacctccctagaatgggagaccatgaccgagaatgaggaggtgacatcaaagccaagtagttctcaaagagcattttctcataaaggaacatcaaaaagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagtctggcttctgttcccaccgttgtgtacagtctcctctgggagaggtcaccagtgccatgagtggggctcgagggcagctccattgttctcaatgcaaagctttactgctgttttgatgctccatacttgaggttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtccctgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaagaggttatggtaaaagtttagaacatgggatcatgtaagtttgtgtattaagtcaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtata

SEQ ID NO: 332151 - DNA, 2711 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgggaaacttatatgcatgcttggagctcagtaccgtcactaatgcctagactactgtggagcatgcgta

SEQ ID NO: 332152 - DNA, 2964 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatccataacaactcaaataaatttcaagggaattaatgctgagtgaaaataatcacaaaaggccatattctgtatgaaaatattcatataacattctcaaaatgataaaactatagagatgaaaaatggattaatggttgccaaaggttagggatggtgggaggaaaaatggggagagggttggatggaactattaaaaggtagcaccagaaaggtctttgtggtgatggaacacttgtgtatcttgattgcagtggtggttacacaaatctataggtgctatacctatacacacatactgtaccaatgttgatttcctttttcattttatgtaagatgtaaccatgaggggaaagtgggtgaagggtgctatctttgcaacttcctgtgattctatcatttcaaaataaaaagtaaaaaccaacaatggcaacgaaaacccaaaactaaagagctgtaaccaactaaagtgtgtgaaactgatttgaaaaaaagttataaaatacatgttttaggacagttgggaaatttgaatatgactggttattagatggtattagggaatttttgttgattttcttacctgtgacggtggtggtagtttgaagaatattcttaatcttaagggatgcatgttgaagtatttggaatgaagtgttctgatgtttacaactttcaaaaaaatgattttaaatatgtattgagagatcaggcaaacatagcaaaatgttcattgttgagtccacatggaaaatacgggtattcaatgtgccatactttcaactcttctgtactctgatattttcaaaataaaacatttgaggggaaattaaaaaaaaaaa

SEQ ID NO: 332153 - DNA, 2805 bp, Homo sapiens
aattctaatcaatatttcatcattgctgtcaatgatagcctgttactaatgaaacaacattctgtcccagcactaaatttactgggacataaatttttcacatggagccaagctcttcactgattaagccaatgcagaatccacttgtgggcagtcagtgcccattaccccctgtgaaccattctgtgcccttgagtacatttgtgggtttaactcagtctatattcttaagttggtaatttttatgttgtaattctcaaagttctgtttctgtagctggactatgaataatacctgaatatgaagattgtgttttttaataatgtcaaagtggtgtgttgattatcataaatgttattaattcaaccccacagtttcttgggggctggttcctcattagagtgaaaggtagccaagagtgaaaactggaaggggcctaaggcttaaagtcttaagacctggatgtggttcaggttttgccatctgcctcagaaaaaatctcttcagttcttggagccttgaattcctcatctgttaaacaggaggaagaatatctacctcacaaagttcttatgagataatgaatataaaaatgtttcatccaggttgttgaatcatcccagcttatataataattacaaaggacatatgtactttaacaatggagaatgctgtgatttacctcttcaccgagtaacaaaatgtcacattgcttagattgagacagcccacataatgtgccaccttctgtgatgtaataagctgaaaaatgttcaacctgaatttaatcaagcttcttggacctcattgccaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatccataacaactcaaataaatttcaagggaattaatgctgagtgaaaataatcacaaaaggccatattctgtatgaaaatattcatataacattctcaaaatgataaaactatagagatgaaaaatggattaatggttgccaaaggttagggatggtgggaggaaaaatggggagagggttggatggaactattaaaaggtagcaccagaaaggtctttgtggtgatggaacacttgtgtatcttgattgcagtggtggttacacaaatctataggtgctatacctatacacacatactgtaccaatgttgatttcctttttcattttatgtaagatgtaaccatgaggggaaagtgggtgaagggtgctatctttgcaacttcctgtgattctatcatttcaaaataaaaagtaaaaaccaacaatggcaacgaaaacccaaaactaaagagctgtaaccaactaaagtgtgtgaaactgatttgaaaaaaagttataaaatacatgttttaggacagttgggaaatttgaatatgactggttattagatggtattagggaatttttgttgattttcttacctgtgacggtggtggtagtttgaagaatattcttaatcttaagggatgcatgttgaagtatttggaatgaagtgttctgatgtttacaactttcaaaaaaatgattttaaatatgtattgagagatcaggcaaacatagcaaaatgttcattgttgagtccacatggaaaatacgggtattcaatgtgccatactttcaactcttctgtactctgatattttcaaaataaaacatttgaggggaaattaaaaaaaaaaa

SEQ ID NO: 332154 - DNA, 2395 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatcaaaaaaaaaaaaaaaaaaaaaaaaaaaaatttgttggggccggcctgggacccagaaaaaggtttctcaaacccttcgtgtgggggcgcgcgggccagtgatgttatgcaacactggggccaacgtgggtcccaaggaacaccgggtcaagaatggcgtggtttcccacccataaagaaccgcgggggcaccggcgttctgacaaatccagggcttcggaggccggctccaccggggccaggggtcgatatacgcgacgcgcggggggag

SEQ ID NO: 332155 - DNA, 431 bp, Homo sapiens
ggtgtggcattaaggatgggcttgtttcttttaataataacgtgaacaattttagagctatatatttcgttacaaattactaatacatcctcatttgagagataaggaaactgaggcagatgtctagctggccgcaaaaccaagtgtcttggtgccaattttagtgttagttgtatttgagcacaaagggctaggtaaaggggtcaataagtagatggtaaataagtagaagagatgtgactgaagtccgatctaaaacttaagtctgaagctaaaatccatgctcttaattactgcttattacttcccattccctccttaacccacacccaggtctggcttctgttcccaccgttgtgtacagtctcctctgggagaggtcaccagtgccatgagtggggctcgagggcagctccattgttctcaatgca

SEQ ID NO: 332156 - DNA, 2118 bp, Homo sapiens
atcgtacataagattctactagaggtaggagtttcctacatacatgacatacgtaggtttattctccactgtgagtatcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtccctgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaagaggttatggtaaaagtttagaacatgggatcatgtaagtttgtgtattaagtcaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtata

SEQ ID NO: 332157 - DNA, 4556 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtccctgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaagaggttatggtaaaagtttagaacatgggatcatgtaagtttgtgtattaagtcaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtata

SEQ ID NO: 332158 - DNA, 3893 bp, Homo sapiens
cccatttctaaatcagggtctatgctattggaagacagactttacatgtgatctccttatgtctccctgatgtctgttatgcactcatggcctcacagtgtatcccttccccagaagtgaagggaacctttcgacaggcaagttcctgggcattggtaatctcacacacacttgttatttcaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtccctgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaagaggttatggtaaaagtttagaacatgggatcatgtaagtttgtgtattaagtcaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtata

SEQ ID NO: 332159 - DNA, 2580 bp, Homo sapiens
tattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagcttggacactcttcactgaagacacatctcgacccataccagagagaccatatgatcaccgttgagtg

SEQ ID NO: 332160 - DNA, 450 bp, Homo sapiens
gttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatggtatttactcagtgctctgggttttgggctgttcaaggacccttcctgtggctcatccccctacttccagggagttgcttcctctgctaccctgtctaggagtctcttacagtgccaatttctttctgctgttctgttgttctctccttctttcttgggcccctctgagcttgtatacatcccccctttttttttttgagacggagtctcgctctgtcgcccaggctggagtgcagtggcgcgatctcagctcactgcaacctccgcctcctgggtttacgccattctcc

SEQ ID NO: 332161 - DNA, 843 bp, Homo sapiens
gttgcagtgagccaagatcacgccactgcactctagcctgggcgacagatcaagactctgtctcaaaaattaaaaaaaaaaatgtgactctgttcatgtgtccttctgcttagcatcctttaatagcttctcattgttcttacgatgaaaacccaaaccccagtatggccttcaaggctccatgtggtctggcacctcttactcacaaactgcatcttgacttctgtgccatgctgcccttttagggtgaatgtcccatgctccctgtcaccacagggcctctgcatatactgtcccctctgcctggaatgggccttcccatccttcagctcattaattcctgcgtaatttcagatctcagccaatcttcacttttttgtctaagcctttttattcgtgtgagtctttaaagtctgtcccatcagacctgaagcactgtaaaagggcaaagacagttacaataacctttgtattctccagctcctagcacagcacttgacatgtagtaggtgcttcgacagatacccagtgggaattgtgtgcagggtagaggaagtagcgtctgcagggcgtgagaaacagtagcattttggagaaaactaacatattgatggctaaagtgtgggttttgcagaagacaagtggtaagagatgaagctggaagggcaggcaggacccaggctgtgaagggccctatttggccaatattggtactaggacccataggatgtgggcagtcagtagtctccccgacttggggaaagaggaataagcataggatgaggcgtgagccttgagagatgggtggggcttggcccacttctgattcccctgcgtagaaga

SEQ ID NO: 332162 - DNA, 4449 bp, Homo sapiens
  misc_feature (1350)..(1350): n is a, c, g, or t
  misc_feature (1681)..(1681): n is a, c, g, or t
gccacttactagctgtgtgacttcgggaaacttatttaacttcttgtagcatgagtcttaggcagggctccccagaaacagaccctaagacaactactaatggagggagaactctaaggagaatcctataggagatggagggaagcaggatagagctggggaagaagctgggccagaatacagctgcttcagaactctagtctcagcctgatcccatggagaactcaagaagtcatgagttgcatcacagaggctgttgcacccagaggtgggggtggggggtgtctgttagatcaccacatcagttagtcattggtctcagcttgctcccctcctccctccaccccctggctcccattccctgacaaggcagctctgctcagccagtgacaatctgatggagaggagattaagcatgatccattagcagtcacccctgcagcatttgagggatgggtgggcagacgggccctggcttatgatggttcagcttatgatttttctactttacagtggtgtgaaagcagtatgcatttagtagacaccacgcttcaagtacccatgcaaccattccgtttttcattttcagtattgaataaattacatttattgtacagtattcaatatgttatgtttatttactgtgtggcactcaacactttattatataataagctttgtattaggtgaactgtagactaataaaagtgtcctgagaatgtaggctaggctaagctatgatttcagtaggttaggtgtattaaatgcattttcaacttaaggtagtttcaacttacaacgggtttattgggacgtcactccattgtatgtggaggagcatctgtacctccataaagggaatctgggcagaggaccaacagtatttgctacactcagttacctcctcttcaaaatgataacaaatatagctctcttacaaggtcaccgtgagtattaaatgggataattaaagcacacagggcagatggtaagtatctacatattgtagttcctttctctctcatatttaattttcttgtcttaattgcttctagccgaagaccgcataatttaacatgatttcgtttctttactaggatgaagtggcccaccatcaaaccattccagtacaaattggaaaagagatagaaaaaataacacgcaaaaaagtgtatgatttaatatttttactttgaatccctgccagtccaagttatgtgtgcacactagaacaagagtactaaccattggacacattaaattactatgataattttagaaatttctgctttgggccctgtctaggttgtttatatcaagttctttaaaagaaagtaatgcaccaaattnctatcattcatagtatttatggcttaattatgggtcaagattctgttgccaatttataaatcatatttttatggagaagttcaattgactttaacagagcggtgcatgggataaattatgcgaactggttagaatttcatagtctagaagtatatcagccaggcagcagcccaaagcccaaataatagtaactccccactttgccacccattcatgtgtataacactcctcagatattcagagtagattgggaggcagaggtcattgaggaaattctcagtgtttaaggaaccaaaaaagataaagattttaagtgaagatacaaaaattntggaaaaataatataattactctggtgactaatcttaaggggaaaaattaggcaggcactagtaactgttctaaaaactaagctcaccaacatcaaagttgagaaactcaggtcagtttcaggaggctggtcaggacgagggttgaatcacaggagatggtagcaaattgggatctgcacagaaagtagggaggctgggcaaattcctgccttccgtggcactcagtggagataccctccaagtcccacccatctgtggtctttacccactgctgagatcattgaatttatgactatctcttctgctgcatggttagaaagcaagaataggtaaagccagcatggcctcaaaataaggcaagtgtgtgtgtgtgtgtgtgtgtgtgtgtgtatcccctacagagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaaaaaaa

SEQ ID NO: 332163 - DNA, 4545 bp, Homo sapiens
  misc_feature (1350)..(1350): n is a, c, g, or t
  misc_feature (1681)..(1681): n is a, c, g, or t
gccacttactagctgtgtgacttcgggaaacttatttaacttcttgtagcatgagtcttaggcagggctccccagaaacagaccctaagacaactactaatggagggagaactctaaggagaatcctataggagatggagggaagcaggatagagctggggaagaagctgggccagaatacagctgcttcagaactctagtctcagcctgatcccatggagaactcaagaagtcatgagttgcatcacagaggctgttgcacccagaggtgggggtggggggtgtctgttagatcaccacatcagttagtcattggtctcagcttgctcccctcctccctccaccccctggctcccattccctgacaaggcagctctgctcagccagtgacaatctgatggagaggagattaagcatgatccattagcagtcacccctgcagcatttgagggatgggtgggcagacgggccctggcttatgatggttcagcttatgatttttctactttacagtggtgtgaaagcagtatgcatttagtagacaccacgcttcaagtacccatgcaaccattccgtttttcattttcagtattgaataaattacatttattgtacagtattcaatatgttatgtttatttactgtgtggcactcaacactttattatataataagctttgtattaggtgaactgtagactaataaaagtgtcctgagaatgtaggctaggctaagctatgatttcagtaggttaggtgtattaaatgcattttcaacttaaggtagtttcaacttacaacgggtttattgggacgtcactccattgtatgtggaggagcatctgtacctccataaagggaatctgggcagaggaccaacagtatttgctacactcagttacctcctcttcaaaatgataacaaatatagctctcttacaaggtcaccgtgagtattaaatgggataattaaagcacacagggcagatggtaagtatctacatattgtagttcctttctctctcatatttaattttcttgtcttaattgcttctagccgaagaccgcataatttaacatgatttcgtttctttactaggatgaagtggcccaccatcaaaccattccagtacaaattggaaaagagatagaaaaaataacacgcaaaaaagtgtatgatttaatatttttactttgaatccctgccagtccaagttatgtgtgcacactagaacaagagtactaaccattggacacattaaattactatgataattttagaaatttctgctttgggccctgtctaggttgtttatatcaagttctttaaaagaaagtaatgcaccaaattnctatcattcatagtatttatggcttaattatgggtcaagattctgttgccaatttataaatcatatttttatggagaagttcaattgactttaacagagcggtgcatgggataaattatgcgaactggttagaatttcatagtctagaagtatatcagccaggcagcagcccaaagcccaaataatagtaactccccactttgccacccattcatgtgtataacactcctcagatattcagagtagattgggaggcagaggtcattgaggaaattctcagtgtttaaggaaccaaaaaagataaagattttaagtgaagatacaaaaattntggaaaaataatataattactctggtgactaatcttaaggggaaaaattaggcaggcactagtaactgttctaaaaactaagctcaccaacatcaaagttgagaaactcaggtcagtttcaggaggctggtcaggacgagggttgaatcacaggagatggtagcaaattgggatctgcacagaaagtagggaggctgggcaaattcctgccttccgtggcactcagtggagataccctccaagtcccacccatctgtggtctttacccactgctgagatcattgaatttatgactatctcttctgctgcatggttagaaagcaagaataggtaaagccagcatggcctcaaaataaggcaagtgtgtgtgtgtgtgtgtgtgtgtgtgtgtatcccctacagagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaaaaaaa

SEQ ID NO: 332164 - DNA, 3874 bp, Homo sapiens
  misc_feature (1350)..(1350): n is a, c, g, or t
  misc_feature (1681)..(1681): n is a, c, g, or t
gccacttactagctgtgtgacttcgggaaacttatttaacttcttgtagcatgagtcttaggcagggctccccagaaacagaccctaagacaactactaatggagggagaactctaaggagaatcctataggagatggagggaagcaggatagagctggggaagaagctgggccagaatacagctgcttcagaactctagtctcagcctgatcccatggagaactcaagaagtcatgagttgcatcacagaggctgttgcacccagaggtgggggtggggggtgtctgttagatcaccacatcagttagtcattggtctcagcttgctcccctcctccctccaccccctggctcccattccctgacaaggcagctctgctcagccagtgacaatctgatggagaggagattaagcatgatccattagcagtcacccctgcagcatttgagggatgggtgggcagacgggccctggcttatgatggttcagcttatgatttttctactttacagtggtgtgaaagcagtatgcatttagtagacaccacgcttcaagtacccatgcaaccattccgtttttcattttcagtattgaataaattacatttattgtacagtattcaatatgttatgtttatttactgtgtggcactcaacactttattatataataagctttgtattaggtgaactgtagactaataaaagtgtcctgagaatgtaggctaggctaagctatgatttcagtaggttaggtgtattaaatgcattttcaacttaaggtagtttcaacttacaacgggtttattgggacgtcactccattgtatgtggaggagcatctgtacctccataaagggaatctgggcagaggaccaacagtatttgctacactcagttacctcctcttcaaaatgataacaaatatagctctcttacaaggtcaccgtgagtattaaatgggataattaaagcacacagggcagatggtaagtatctacatattgtagttcctttctctctcatatttaattttcttgtcttaattgcttctagccgaagaccgcataatttaacatgatttcgtttctttactaggatgaagtggcccaccatcaaaccattccagtacaaattggaaaagagatagaaaaaataacacgcaaaaaagtgtatgatttaatatttttactttgaatccctgccagtccaagttatgtgtgcacactagaacaagagtactaaccattggacacattaaattactatgataattttagaaatttctgctttgggccctgtctaggttgtttatatcaagttctttaaaagaaagtaatgcaccaaattnctatcattcatagtatttatggcttaattatgggtcaagattctgttgccaatttataaatcatatttttatggagaagttcaattgactttaacagagcggtgcatgggataaattatgcgaactggttagaatttcatagtctagaagtatatcagccaggcagcagcccaaagcccaaataatagtaactccccactttgccacccattcatgtgtataacactcctcagatattcagagtagattgggaggcagaggtcattgaggaaattctcagtgtttaaggaaccaaaaaagataaagattttaagtgaagatacaaaaattntggaaaaataatataattactctggtgactaatcttaaggggaaaaattaggcaggcactagtaactgttctaaaaactaagctcaccaacatcaaagttgagaaactcaggtcagtttcaggaggctggtcaggacgagggttgaatcacaggagatggtagcaaattgggatctgcacagaaagtagggaggctgggcaaattcctgccttccgtggcactcagtggagataccctccaagtcccacccatctgtggtctttacccactgctgagatcattgaatttatgactatctcttctgctgcatggttagaaagcaagaataggtaaagccagcatggcctcaaaataaggcaagtgtgtgtgtgtgtgtgtgtgtgtgtgtgtatcccctacagagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaaggtaaacattattgcttaaaattgcatctgttagctcctcgttgatgtagtttcacagatacctatggtactgtttcatgttatgctgacagacctatccttcattattctagtcactaatatagtccttttgttgtaatctagtcatacattctaagcttgatttagacacttgccaaaagaagttccaatccagtggtttcgagattccaaaggcacatttctctcatgacccaaaggagtaattttggcatcttaaatggattaatttgt

SEQ ID NO: 332165 - DNA, 2581 bp, Homo sapiens
  misc_feature (32)..(32): n is a, c, g, or t
ggaaactcgaaagaaattgttggggacatcantttcgtcctaaaggatgaagtggcccaccatcaaaccattccagtacaaattggaaaagagatagaaaaaataacacgcaaaaaagtagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaaaaaaa

SEQ ID NO: 332166 - DNA, 1563 bp, Homo sapiens
acctttgggactttcagagacattgtggctagccaaccacatggtcagcctcaaagttgagaggctcagtaaccctcctatccctagagaattccaaagtgtggatgtaatttaactagaaagccattggtgactatctgtgatcctctggaagtatgctatgttgtgtatatcttgcatccaaagccagagggaaccacaatgactagtaaaacggtggtctcaatgcccacttagcctctgcctctgaatttgaccatagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaaaaaaa

SEQ ID NO: 332167 - DNA, 1492 bp, Homo sapiens
acctttgggactttcagagacattgtggctagccaaccacatggtcagcctcaaagttgagaggctcagtaaccctcctatccctagagaattccaaagtgtggatgtaatttaactagaaagccattggtgactatctgtgatcctctggaagtatgctatgttgtgtatatcttgcatccaaagccagagggaaccacaatgactagtaaaacggtggtctcaatgcccacttagcctctgcctctgaatttgaccatagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatgctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaaaaaaa

SEQ ID NO: 332168 - DNA, 129 bp, Homo sapiens
gaattcagtagagacagcttgtatctgctccgagatgtctggtacctctgttggagaaacgcagatggctgggggctgacattatttgatcacttccatgtcaggtgcctgggatgggatggctgaagg

SEQ ID NO: 332169 - DNA, 3894 bp, Homo sapiens
ccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcc

SEQ ID NO: 332170 - DNA, 4067 bp, Homo sapiens
ccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctct

SEQ ID NO: 332171 - DNA, 4258 bp, Homo sapiens
ttcctttgtctttgaagacccacagaccaccaggcacccctgcaggcatccctccccaggccaaacctcccctgcccgggctctggctgccctcctgggccagttctgtcttggccaaagtgctccctgtccactcaaggtctggggagggcagaggacaggtggccgccccttggcctggcctctaggcccaggcttccactacccagtcagtgttgccacagataggggaccagccccgcccatctctctgcatccaggagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcc

SEQ ID NO: 332172 - DNA, 4371 bp, Homo sapiens
ccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcc

SEQ ID NO: 332173 - DNA, 842 bp, Homo sapiens
gccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaattcgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaaga

SEQ ID NO: 332174 - DNA, 865 bp, Homo sapiens
gccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaattcgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagaaaaaaatcgacgcgcccgcgaat

SEQ ID NO: 332175 - DNA, 2195 bp, Homo sapiens
gcggccgccgcccccgggctggggtttgggggaccgagccgctccgggttcgggatgctgaggagaccgcgggcccgcgccagcctcccacacacacacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtggggggaagtttttcattagggaatacagtctgcgtgacatgggagaatggatggagggagctttgctactctgctcttggc

SEQ ID NO: 332176 - DNA, 2141 bp, Homo sapiens
cgcgaggggccgccgggcgcagtcagccgccgccacctccgccgcgctctgtccggacggacgctcgccgcccgcagcctgccgcccgccgcagggcgctgacggtcccgcacgtctgccgctgccaccggcgcgcccgaaacttccagcactatgttgaataagagtggtgagagcagatatcctgccttgttcccggtcttagggggttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtggggggaagtttttcattagggaatacagtctgcgtgacatgggagaatggatggagggagctttgctactctgctcttggc

SEQ ID NO: 332177 - DNA, 2072 bp, Homo sapiens
cgcgaggggccgccgggcgcagtcagccgccgccacctccgccgcgctctgtccggacggacgctcgccgcccgcagcctgccgcccgccgcagggcgctgacggtcccgcacgtctgccgctgccaccggcgcgcccgattcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtggggggaagtttttcattagggaatacagtctgcgtgacatgggagaatggatggagggagctttgctactctgctcttggc

SEQ ID NO: 332178 - DNA, 1972 bp, Homo sapiens
  misc_feature (31)..(31): n is a, c, g, or t
  misc_feature (34)..(34): n is a, c, g, or t
  misc_feature (37)..(37): n is a, c, g, or t
  misc_feature (39)..(40): n is a, c, g, or t
ctccttgcggccgccagtgtggtggaattcnctngantnnttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtggggggaagtttttcattagggaatacagtctgcgtgacatgggagaatggatggagggagctttgctactctgctcttggc

SEQ ID NO: 332179 - DNA, 527 bp, Homo sapiens
gcggccgccgcccccgggctggggtttgggggaccgagccgctccgggttcgggatgctgaggagaccgcgggcccgcgccagcctcccacacacacacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaaggtgcgtgggcccccgcacgtcctgctcgcccaagccctggcatcgggtccccgggcgtgggaggcggctgggatgagctgggaggctaggaggaggatggcgaggacgctgcccccgcgttggcggtgggcgcgcgccttggggggtgcggcgtggcagtgttttcctggtccccgtccactcctcccctttctttgtggcgcttgtctcgtgccccgttgtcacagtgtgcatggcagtggtcggggtggagacctcttccct

SEQ ID NO: 332180 - DNA, 2353 bp, Homo sapiens
ctcagttatttctaatattttaccattataaatattgttacttcaagggttgagttattaggttaaaggctaaagagtttgaagaatcttaaaactttttttctttttgcacttctctgaggttgaacattttcatgtttattaattactggcattattttagtgaaatgccttttagtgaataaatgcaacttgcaaagctttttatattggatctccagtctctgaaatagtgccaggtacataatactcagtaaatatttggcatggtgaatgaatgaatgaatggcaagaatattaacactttgtctaccatatttgtttcagatgaggtcattgtgcctctatacgtgcacaatgataatgctgtcttggttcttagtctttacctattttttttccattcttttcttcccccacattcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtggggggaagtttttcattagggaatacagtctgcgtgacatgggagaatggatggagggagctttgctactctgctcttggc

SEQ ID NO: 332181 - DNA, 1822 bp, Homo sapiens
  misc_feature (31)..(31): n is a, c, g, or t
  misc_feature (34)..(34): n is a, c, g, or t
  misc_feature (37)..(37): n is a, c, g, or t
  misc_feature (39)..(40): n is a, c, g, or t
ctccttgcggccgccagtgtggtggaattcnctngantnngctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtggggggaagtttttcattagggaatacagtctgcgtgacatgggagaatggatggagggagctttgctactctgctcttggc

SEQ ID NO: 332182 - DNA, 184 bp, Homo sapiens
agcagtgattttccacaaagacaccaagttaattcagctgggtgaggagaattctttcaacaaggggtgcaggaacaattttatatccagaagcatgaaaagaaaacaaaacaaaacctgagcacttacctcacagctcatggaagaattaacttgaaacatatcataaacttaaatgtaagag

SEQ ID NO: 332183 - DNA, 742 bp, Homo sapiens
gtggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaagtaagtga

SEQ ID NO: 332184 - DNA, 851 bp, Homo sapiens
attaaggcttaaaccagttgaagaactttattcttcaaagatacttgcatttcaacaaggaaggaagcttttaaggaagagaaaaacaaccctcattgtggttttagtaagcattaaggggaggacatgaattcagcttatatgtgcctggaatcccatcacaaagctacatagtaacaaagcttctgagaaaggcagtatcttatcaatgtcatattttttctttctttctgtgttttacatttgattttttttaacgttttgttttttagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaagtaagtga

SEQ ID NO: 332185 - DNA, 671 bp, Homo sapiens
tgacagccgtgctatcatcatagcagaaatccgcactcaggtgttgagatacaaggcgagccccagagcgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaagtaagtga

SEQ ID NO: 332186 - DNA, 6012 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332187 - DNA, 3056 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaataggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctct

SEQ ID NO: 332188 - DNA, 219 bp, Homo sapiens
ctgcaacagtgggagggaagagccagatgcaaactcgttctgcgagcccgaggttccgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggg

SEQ ID NO: 332189 - DNA, 5266 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332190 - DNA, 5396 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332191 - DNA, 6082 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332192 - DNA, 5931 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332193 - DNA, 5808 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332194 - DNA, 5675 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332195 - DNA, 5085 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332196 - DNA, 4722 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332197 - DNA, 5563 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctgggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332198 - DNA, 5173 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatcctttttatattatatattagggaatgggagattcagggccttagggacgacccaggatgggacgggaacagggcgagggatctagggaatcacggaaaccatcgcgacaccgggatacaagcaagtcatcccgcaaacagccccacagagaaccggggatcaacaggccgcaaacacacgacggaaaaaaggga

SEQ ID NO: 332199 - DNA, 2445 bp, Homo sapiens
tggccaacatggtgaaaccctgtctctactaaaaatacaaaaattactgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332200 - DNA, 3303 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaataggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtc

SEQ ID NO: 332201 - DNA, 1442 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcaggtgagcacaaccttgttt

SEQ ID NO: 332202 - DNA, 699 bp, Homo sapiens
catgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggc

SEQ ID NO: 332203 - DNA, 485 bp, Homo sapiens
tgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaagaggagctggttcaggagatcacacaacatttattcttcttacaggtacatcagtcaaggctaccccccagttctgagagaacttgcccaggagtggttgcagagttggcctcagagttgaccacaaacacctttgtattgcaaaaatattctacctctggaaggtcagcccctttggttctgtaatggaaaaaaggcttcagaacagaactatacttgagtgatgaaaattggtgtcagatgaaattgtgaaggtgtgatggtgaagaatggatacaagtagctacctaact

SEQ ID NO: 332204 - DNA, 6057 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332205 - DNA, 2172 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaacttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctct

SEQ ID NO: 332206 - DNA, 6173 bp, Homo sapiens
  misc_feature (631)..(631): n is a, c, g, or t
  misc_feature (641)..(641): n is a, c, g, or t
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagtcttgctctgtcaccctagctggagtgcagtggcgtgatcttggtttactgcaacctctgcctcccaagttcaagcgattctcctgcctcancttcccaagnagctgggactacagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332207 - DNA, 5934 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332208 - DNA, 5925 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332209 - DNA, 5031 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctggtttctgtttctgtttttttttttggaaatggagtctcgctctgtcgcccaggcttggagtgcagtgtcacgatctcagctcactgcaacctccgcctcccaggtacaagagattctcctgcctcagcctcccgagtagctgggactacaggcgtgtgccaccatgcctggctaatttttggtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 332210 - DNA, 4310 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcactgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaaggtgaagcagatgggccgtgcagactgggccggtggagctcagagtctgggccagtgagaagcagcacctgtggagccacagggcttacagatcctggtcatagccgggttacgggtgctgactgcagtacgaccagggagtaccccag

SEQ ID NO: 332211 - DNA, 2581 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaacttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtc

SEQ ID NO: 332212 - DNA, 1340 bp, Homo sapiens
gcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagccaaaggcatgggatggacaaaaatgcctgcccccgtgaaactggttggggagggcagttccccagcatccataaagtaataaagtcactgtgtgtaggcccgga

SEQ ID NO: 332213 - DNA, 1476 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgggggaaaaaaaacccccagggggggacacaaacgaagacccgacaccccaaccagtaattggtaaaacaaggagggggccacacaaaacagagggaggcaaaatataataagacacaagaggcaaaggagcgcgtgataaaaaaaagagaaaaagaagagaggaacaaagaggcaaaaagggagcactaggatgaaacagaaacacataaacaggacggagggggaggaagaaaacaatgtatgtgggcccacaacacaactaccaccagagaaaaaaataatagaacgaggcatcgatagggggggagatataaaagaaaaaaatcgagagagaggagtataaagggaggagataaaaaaagaatgggaacaaaatgaggagagaagacgagaaacaaacatgtaaggaacaaaagaaaaaatataatctaaggagagaaaatatttataaccagcgggacggatattcaatactaagaa

SEQ ID NO: 332214 - DNA, 2132 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaattacccagtttccttatctataaaatggggacatcagcaatgttcttcacaccctgcaagggctgggaattgcgcatgtgaacttggagctgcatttatgagcactgtagacaaatgtttgtatctgtcac

SEQ ID NO: 332215 - DNA, 583 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagaca

SEQ ID NO: 332216 - DNA, 459 bp, Homo sapiens
gcctccctatgggttagagaccagggctgtctgtagagggctttgcatttataaagggattcaggggttatttcatgcatttcctacaacatcccggccagggagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagaca

SEQ ID NO: 332217 - DNA, 2054 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacatgcccattataagacaaactcaagggggggcccggtgcccaatacgccctatagtgag

SEQ ID NO: 332218 - DNA, 1558 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatggggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagaca

SEQ ID NO: 332219 - DNA, 843 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaattacccagtttccttatctataaaatggggacatcagcaatgttcttcacaccctgcaagggctgggaattgcgcatgtgaacttggagctgcatttatgagcactgtagacaaatgtttgtatctgtcac

SEQ ID NO: 332220 - DNA, 649 bp, Homo sapiens
actcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggtaagagagagcagctgcccttgggtttgagacaaaacacaagggctttgtttatttttgagggcaattcccagcctgaacttgcacagcctccctatgggttagagaccagggctgtctgtagagggctttgcatttataaagggattcaggggttatttcatgcatttcctacaacatcccggccaggggtatttataaccctgttttatggatgggtaagtggaggcctggagaggtggccttgccaaaggtcccatggtcagtgcgtggccgatcctggttttaaacccagccttcctctgaccagtgtttgttaggttaggttctcttatctgtgcacattctgaaacgataatgataaaatcttaagcctttggggtttttaacctgaacaggaagaaaagatcccagcagtcggagctctggtctgggctctgtagacttcaaattgctctcagggcaccggattcctacaggcagccccagaggagtg

SEQ ID NO: 332221 - DNA, 1996 bp, Homo sapiens
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagaca

SEQ ID NO: 332222 - DNA, 1856 bp, Homo sapiens
  misc_feature (1761)..(1761): n is a, c, g, or t
  misc_feature (1767)..(1767): n is a, c, g, or t
  misc_feature (1801)..(1801): n is a, c, g, or t
  misc_feature (1814)..(1814): n is a, c, g, or t
  misc_feature (1834)..(1834): n is a, c, g, or t
  misc_feature (1839)..(1839): n is a, c, g, or t
tgcgaaggttctggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctggtgggctatntcgctnttggggaccacgagggatggccagtgaggagggntcagagtactgtnaggggaggactgaggctggnttctnggatctttaggagcagt

SEQ ID NO: 332223 - DNA, 1093 bp, Homo sapiens
cagctcagctcgtggttagccataggcagcccctgtcttcagccctcacgcgctaccccctccagtggtggccgtgcctttacccgggacactttagggggtctgtgctggggcgaggacggggatggaaagtcgatccatggagtgctcagctaaaaacaaggtttgtcctatttttacataaatcgcgccaatggagtatcactaggccgcgaccaggagagagatgcctctgcccctccagccctagccgagggtggctccataggacggcgtctagtgctcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggccagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaattacccagtttccttatctataaaatggggacatcagcaatgttcttcacaccctgcaagggctgggaattgcgcatgtgaacttggagctgcatttatgagcactgtagacaaatgtttgtatctgtcac

SEQ ID NO: 332224 - DNA, 892 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacggaaccaatttttcccccgggggccctttggggggggaaaaaaaaaaacccttttttttttacg

SEQ ID NO: 332225 - DNA, 242 bp, Homo sapiens
catgatgacagacgaatgtgcagctcttcctaccctcaagtatgtccgaccaggtggaggctttgtccctaatttccagctctttgagaaaggggatgtcaatggagagaaagagcagaaattctacactttcctaaagaactcctgtcctcccacctcggacatacttgagggtaggaaggatctctgagttctctcctggttcctgttttccaaattggttgcagggaaagcccagaatg

SEQ ID NO: 332226 - DNA, 2239 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332227 - DNA, 2013 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgatgcaaacacacaatgcagctgcaaacacacaatgctgctgcaaacacacaatgcagctgcaaacacacaatgcagctgcaaacacacaatgcagctgcaaacacacaatgcagctgcaaacacacaatgcagctgcaaacacacaatgcagctgcaaacacaatgccgggga

SEQ ID NO: 332228 - DNA, 1894 bp, Homo sapiens
atgctgcggtcgctctagagatccctcgaagatggcggtatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332229 - DNA, 2191 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaattgtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332230 - DNA, 2156 bp, Homo sapiens
cactgaggaaactggggagctgggccagggcctcatctgtgttcctgatttgccaaagattatgggagggttgtaacctcaccccaaagaagttctctgccttgtatccagggatggatagttcttgctccagaaaactcaatcctgagggttctgaatgagtgctctagctggcccaggtggagggccttggcaatgggcaggtgactgacagctgacttgaggaagggtattattcttgtcctccaaacctccaatccatccagattagagtcaagaggataggacctgagtcccagcattgctgtgaactcactggtgatcctgcgcaagtccctccctttctcgggcctcagtagttccagcggcacagcgggtgagccgggggagtggtgtggatgagacagggctcctcgccaggatactcccacatctgctctttctctttggcccagaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332231 - DNA, 1676 bp, Homo sapiens
gctcggtaccggacttcctggtgtgttgtgtaagtgaactattattggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332232 - DNA, 1861 bp, Homo sapiens
  misc_feature (1789)..(1789): n is a, c, g, or t
  misc_feature (1798)..(1798): n is a, c, g, or t
  misc_feature (1811)..(1811): n is a, c, g, or t
  misc_feature (1827)..(1827): n is a, c, g, or t
  misc_feature (1830)..(1830): n is a, c, g, or t
  misc_feature (1834)..(1834): n is a, c, g, or t
  misc_feature (1842)..(1842): n is a, c, g, or t
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccanccgtggggnccattattaaaangcgttcaggcgcggcncgnttcntggccgcnccagtaaactatgtgccgg

SEQ ID NO: 332233 - DNA, 2283 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggctccccgccagatgggcaatccccagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaaatgtccgagcgcacggtggagggctatgtctcctagagtttccagtctctttgacgaaagggggatgtcaagtggagacgaaagagcatgaacattctagcacttgtctctaaatggaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332234 - DNA, 2191 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332235 - DNA, 1845 bp, Homo sapiens
  misc_feature (1715)..(1715): n is a, c, g, or t
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggacccctgctccttcggaggacgtgccctcacccctcactggtccactggcttgagactcaccccgtctgcccagtaaaagcctttctgcagcagctganaaaaaataatacttatttttttttcattcatcttcactttcttttcttctttatttctttattattaaatcccttctataaaaattaataaaaataaaccgttaaccttaaggggggcccggacccaaag

SEQ ID NO: 332236 - DNA, 2067 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctcctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332237 - DNA, 1390 bp, Homo sapiens
  misc_feature (48)..(48): n is a, c, g, or t
aattcgcggccgcgtcgacgtggtgccagcgcatgatgggtataccanctggccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332238 - DNA, 1352 bp, Homo sapiens
tcctgatatgggttggagacacggatttcttcctgaacaaatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332239 - DNA, 1995 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaacccccccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332240 - DNA, 1340 bp, Homo sapiens
  misc_feature (20)..(20): n is a, c, g, or t
gggtgggcccgacctctagncccaccaggcaacttctcaaagttccagcggatgtcgtgaaccttcatgggttcccagaagaggcggtcagatgtacccaggggctccgaggtgggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332241 - DNA, 1593 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaacctgctccttcggaggacgtgccctcacccctcactggtccactggcttgagactcaccccgtctgcccagtaaaagcctttctgcagcagctgacaaacacacaatgcagctgcaaacacacaatgcagctgcaaacacacaatgcagctgcaaacacacaatgcagctgcaaacacacaatgcagctgcaaacacacaatgcagctgcaaacacaatgccgggga

SEQ ID NO: 332242 - DNA, 1093 bp, Homo sapiens
  misc_feature (84)..(84): n is a, c, g, or t
gctgcagaaaggcttttactgggcagacggggtgagtctcaagccagtggaccagtgaggggtgagggcacgtcctccgaagancaggtttttcgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332243 - DNA, 1022 bp, Homo sapiens
ttcagaggtcccagagaggcgaagtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332244 - DNA, 866 bp, Homo sapiens
tcgaatgagctggtcccaccttatgcgtgggcacctcatgcggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332245 - DNA, 1090 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctagaaccggggatgagatcctctagatgac

SEQ ID NO: 332246 - DNA, 1055 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagctccctgccccgctcagcacctgcttgggaggcactgacttaggcgagctgcatgcttggggacacgcgcgcccctcccaaacagg

SEQ ID NO: 332247 - DNA, 860 bp, Homo sapiens
aggctctttggaagtatatacattatttacataatgtgtacaagtccttctgaaatgacaactttaatgggtttcagctcttttatatagagcttgagataatccaagaccccttattcagagactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332248 - DNA, 752 bp, Homo sapiens
  misc_feature (9)..(9): n is a, c, g, or t
aatataaantaataaatctccactcaaattaaactttattaatggccctaaagagaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332249 - DNA, 856 bp, Homo sapiens
aggtcgggagtttgagaccagcctgaccaacatggagaaaccccatctctactaaaaatacaaaattagccgggcgtggtggcatgcgcctataatctcagctacttgggaggctgaggcaggagaagtgcttgaacccaggaggcggaggttgcggtgaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332250 - DNA, 798 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtactcctccccatcaatggtgagggctccgtactcgtaaatggtgccacttatgccaccatggcagtccatctgacccatctt

SEQ ID NO: 332251 - DNA, 850 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaaatgtccgaccaggtggaggctgggagtgactgcttaccttggctttctggagtacagtgcctttgcctgtgaccacgaccgagagaggcctgttcttgagtgtggttgcagagttgactggggtacagtctggggcagaggcaggtgtgacagctttggggcgggggctcacgttctccagtgggtggtgtcca

SEQ ID NO: 332252 - DNA, 819 bp, Homo sapiens
  misc_feature (768)..(769): n is a, c, g, or t
  misc_feature (784)..(784): n is a, c, g, or t
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagctctgtctcccnnctcgagctcctgggnactctgctgtccgggatcctctagacgccacccgg

SEQ ID NO: 332253 - DNA, 1845 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccaggaaccggggatgagatcctctagatgac

SEQ ID NO: 332254 - DNA, 1770 bp, Homo sapiens
ccatggatatctcagcagtatgctggcaaatacgtcctctgtcaagtgcgaggcgtggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332255 - DNA, 2256 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaaatgtccgagcgcacggtggagggctatgtctcctagagtttccagtctctttgacgaaagggggatgtcaagtggagacgaaagagcatgaacattctagcacttgtctctaaatggaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaaaaaaaaaaaaaaaaaaaaaaaaaaaaaaaaaaaaaaaaaaaaaaaaaaaaaaaaaaaaaaaaaaaaaaaaaagagagggggcggcgcgcgccccaaaacttctccccggcgggggcgcgccccggagcgcgcccccccctgttttggtgacaaagggggcggccccacagagagagaggagagctatctatattatataccagacgagcgcggcgcgcggcgcgcgcgggttattaacaacgacaacgaggcgagcgggggggagagaaaccaaccggcggagcccgcggaggcgattcttatgagtgagaagaggcgccccccctcttatctcgcgcggggggggggggcacgcacattcagggcggcggcacaccacaccctcgcgtgagg

SEQ ID NO: 332256 - DNA, 1811 bp, Homo sapiens
  misc_feature (1771)..(1771): n is a, c, g, or t
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccacgccccccccccccccccgaccncccccccccccccacactaacccctacaaaacacaccccc

SEQ ID NO: 332257 - DNA, 1555 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccgggttaggtctacctgaaggtctacctgggtacctacctggcttagtcaaccg

SEQ ID NO: 332258 - DNA, 1429 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacaggaagagcgtgcaccattcggtctggtcattctgggctttccctgcaaccaatttggaaaacaggaaccaggagagaactcagagatccttcctaccctcaagtatgtccgaccaggtggaggcttgtccctaatttccagctctttgagaaaggggatgtcaatggcagagaacgagcagaaattctacactttcctaagagaactcctgtcctcccacctcggacatacttgagggtaggaaggatctctgagttctctcctggttcctgttttccaaattggttgcagggaaagcccagaatg

SEQ ID NO: 332259 - DNA, 970 bp, Homo sapiens
agccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtgagtactcactcagcatcctgagaaagctcctctcacatggcccacatcttgttatcaaccccaaatcatggtggacatttatcggccaccaagaactactctcctcttctaggatccccagtggaatgagggaagggaagggacaagagagggagaaggacagggacaactggttgtgatgtgcatccgcagggagcaccaaggttgagggacactgaaaagggaccaggctagaaaggaagaccgtggactcacattatgcctatgcccactgcacattcactggctcctgctgcccactgcagaataaa

SEQ ID NO: 332260 - DNA, 365 bp, Homo sapiens
aggcccaaactgagacttgaaagacaggaagaccacgagatcgaggagacaggttagccaaggtataaaacgaaactgggatagacagcagtgtccagcacatggcgggttcttcatgaacatctgtaaaatgagtaaatacaaacgtgcctaaaccaagtaaatgaagagaccatccaggttatcctgccctgtctaaaatccagtcactgccctgggagtcctgccttgcatggtatcatcgcccctgtttcagcacagggagttcctgtccctagaaaaaccctgaccctggttaacccagagacagctgaaatacagaaacaccaaacatcttcttgcccctaattaatggcctctgactg

SEQ ID NO: 332261 - DNA, 428 bp, Homo sapiens
gatctctcccatgtaagcagcacggagcagctagagagcagagtgaaggctgcagatctgcgtgatcggcacagaagacacacaggcagggggcccttaatagcctcattcagcaacccacagcggcaagattaggatgggaagcagaagtcacaaaaatgtggactaattcataagccactgaatcactcctgctgccttaacactagattctagccctactggtcttgcaacacaaagtgaaaaggcaaatcttgcaaaacacacggtgcttcacaaagtcaaagtaaagtgacatgggatagctgcctgcatcaccacaaagcaaacaataaggaggacctggcagttagggcacctatgcctgaaggaaacacaaggctggtgacccagcaagtgctttaaaagagaatgatttggtcccagct

SEQ ID NO: 332262 - DNA, 344 bp, Homo sapiens
catctaaaggttgagttaaagcctcaagaggtgcagcaccagggacaggagctctcagccagctttggtgaacaatgccgcaggccagacccagctggtacctgctcctacacagcccacagtgctaagaatggttcatatttcttaatggttggaaaaaatgaacaaattaacattttatggcatgtgaaaattacatgagattaaaattttgttgtccacaaaatttttttctttttttaaaataagagtcagggtctcgctctatcgcccaggctggagtgcagtagtataatcatggttcactgtagccttgacctcctgggttcaagcgatcctcccat

SEQ ID NO: 332263 - DNA, 354 bp, Homo sapiens
cctttgcttaatttcccaggtaagagtgaggagcatggctgactggaggtggtggactgggtggggtctgtggctgaaatttcttggacctccccttggtggtgtgaggtcacagatgcaggtagcagactccagattatcacattacgctgtgggcttcagcagccttgccagcccagcttctgtctgggagtggatcccccaaaaaaccctttatccactgtcctctcagcacacattgtgcttctcctggttctctccgctaatggtggtgttttcatccctgactggctcaccctctgggtctatccccaagagctcacattactagcaggtgttctctccttgcctgat

SEQ ID NO: 332264 - DNA, 453 bp, Homo sapiens
gcacgtggtcttgggggaggaagaggaaaaagtaaaaaagacacgtgccagatggacgggaggcaacataattacgggaaccaagcaggataaaattctagaaagatgatttgacctttcgaagaggtcagaattgttgaggatttcaacagaaggtcgctgatgatcttccagagtgtggtttcagagaatggaaggtacagaggcagaatctaagggggtaaagaatgcatagatggtgaagaggaaaaaacagaatgtgtctcttgggatgttcccagtgaatggggagggcagagtgacctgagggagcagcgtgttgagggaaggtttttctgaggttggaatgaccctgaaggacggagccagtagagagggagaaactgatgacttagattaagcttcacaggcaggaggtggaggaagaggtgaagggcacataccgtcggcctt

SEQ ID NO: 332265 - DNA, 476 bp, Homo sapiens
tttagcctcacatatatagctgcctcctgccatgacatgtccctcttgcccagagccatactctgagacttcacagacatcaggacctaggtaataaatatatacctaaagcattgagagatggtagtgaagacagtattgtttaatttcctttttatttgtctctaattcagctcctctagactgtaagcttcatgagggtcatttgcaggcatgttcaccaccataccccagcatctagtacagtgctagaccttgagcctcataattgtaaagtgatgggtgtttgtggttccactcacttgtcctcttcttcacattattgggttcttgtcaagccaccttaatctgcctttgtttgatcccaagtgttttggtaaagatctctttgaaaggtgaagatttttctgacccctattcttaagctaactgaaagcattccaagatgaatccttttcagaaattaacaggctcca

SEQ ID NO: 332266 - DNA, 402 bp, Homo sapiens
ctcctgctagaaccgctgacaaccattttggaccacaatccacaagaaaagggaggcagcgttaaagatggtgaaaaactgtgtaagccttggcaacactttaagccttggatcctccaggccttatgtttcactcctagattcttcaattacataaaccaacaaatcccctttctgcggaagccagttcgaggcgagattctgtttcaaggtcgacagaatcctgactaatgaaatccgaagtgctgtggtgtatgctgcatgctggctatacacagatgaagcaaggtgatccataccatccttccaggcactcacaggctgatgtggagacagccacaaacaattacagctatttaaagccaataagataactgctttaattaaatactacacagtgca

SEQ ID NO: 332267 - DNA, 203 bp, Homo sapiens
ggcgggccaggaggtgtccatctgccggggtgtttgtggggcgagggaacaagggagaggttttttttctacccggaagcctgagagtgaagggggtgaaactcggatttggggaaggaaacaggaactttgcctcagggcacatttggtttccagcaacagattcacacgggctgagctccctcccagcttgcctgggcctc

SEQ ID NO: 332268 - DNA, 821 bp, Homo sapiens
catgcaggtgagcaccaatgttcacttccggtgttcgttccagagaattctgtttaacaaatagaatggtttgttggtgtttgcatgtgtctgtgtcaatatgtgtgcatgagtgtgtgtgaggaatgtgtgtgtcactgagtgtgcatacgagtgtgtgtgtgcatgagtgtgtgtctgtgtgtatgcgtgaatgcgtgggtatgtgaggagtgtgtgtgcatgtgtgtctgcgtgaatgcgtgggtatgagtgtgtgtgtgcatgagtgtgtgtgtgtatgcgtgaatgcgtgggtatgtgaggagtgtgtgcatgagtgtgtctgtgtgtatgcgtgaatgcgtgggtgtgtgaggagtgcttatcagtgcattgtgcgtgtggagtgtctgtgcgtgtctgttcatgggttgcatatgtgttgagtgtgcatgtgtgttgagtgtgcatgagttgtgtgagtggatgtgagtgtacctgtgagtttgcgtgtgtgtgcatgcgtgtgagttgtgtgcgtgtgtgtgcatgtgaattgtgaggagtgcatatggagtgcatgtgttgtgagtgtgcatgagttcacgtgagttgtgtcagttgtgtgcgtgcgtttgtgagttgtgtgtgagatgtgtgttgtgtgcatgagttgtgtgcatgagatgtatgtgagttgtgtgcatatgcacgtgtgagttgagttgtgtgcatggagtgttatgtgcgtgtgcatgtgtgtgtgttgtgtgcatgagttgaatgagttgtatgtgtgtgttgtgtgcgagttgagtatgatgtgtgtgcgtgtgtga

SEQ ID NO: 332269 - DNA, 375 bp, Homo sapiens
cttggcctcccaaagtgctgggattacaggcgggagccactgcacccggccacacgtggttattttaaatttgcttttgaatcagtgacacgttcatgtttttaaattttgaagtatgaaaaggtgcagagaggtttccttttttcctcttctgtccatgcaggtgagcaccaatgttcacttccggtgttcgttccagagaattctgtttaacaaatagaatggtttgttggtgtttgcatgtgtctgtgtcaatatgtgtgcatgagtgtgtgtgaggaatgtgtgtgtcactgagtgtgcatacgagtgtgtgtgtgcatgagtgtgtgtctgtgtgtatgcgtgaatgcgtgggtatgtgaggagtgtgtg

SEQ ID NO: 332270 - DNA, 458 bp, Homo sapiens
gatcacctgaggtcaggagttcgagaccatcctggccaatatggtgaaaccctgtctctcctaaaaatacaaaaattagccaggtgtggtggcatgcgcctgtaatcccagctactcaagaggctgaggtaggacaatcacttgaacctgggaggcagaggttgcggtgagccgagatctcaccattgcactccagcctgggcaacagagtgagactccatctcaaaaaaaacaaaacaaaacaaacaaaaaagaacaggtggggacagactagggagtaggccttcagctgggggacagagtgacagcccccggcaggaaagtcaagccctagatttcacactagcttccttgttctcccaacaaccacgagggaaggttgtcatcattcctattttgcagagcagaaagctgaggcttggaatatgtcgcctgaggtcacgcagctgggatgctga

SEQ ID NO: 332271 - DNA, 432 bp, Homo sapiens
gccttttcggggccctcaccccgacccacaccgcttccattcttgggtgcaaagggccttccttaacagtcggcggcagctctggggccggcgcatttttttctgtgggggacacccggcacaagaagggtggaggaatggggctgcgcgtcactcccacagcttcttagagagccgttcgcaaggaggaccgagtgtcacgtgagtgagctggaggaggtcacgttaccttcctcctgtgagaggctcaaacacagctcaggattttaccagtatggagagaagaaaccttcaggcggggcgcggtggcgctcctgtggccccagctactctggaggccgaaacaggaggattgcttgtgcccgagtcgaggctgcagtgaagccgattgtttcactgcactccagcctgggcaacagaggcaagaccctg

SEQ ID NO: 332272 - DNA, 436 bp, Homo sapiens
catggttcacgaggcccttctgcattgctgtcttctcagcacctagcacagttgtgtaggaattttaaaatgtgtatctgtttaacaaatcatttgatcccctcatccccacataaatgcacaggtctctcccgtagcctggcttcctctgctggagggacatgccgctgttgtgcaagggctggggaagcaagcaccagccaggttcagagagccattcatctgcagccagggttcattttcttagtctagccactgaaacgattgttatcaacaggaacctgtggtgaacatcactttgcttccttctctggcaacagctgcctcagaaacctagccaaaggctcattgggtcttgtccttagatctcatgtccacacacttccctgttcaaaactctaggagccaggtacaggaaacccagcctctcctggga

SEQ ID NO: 332273 - DNA, 223 bp, Homo sapiens
gcagaactgagttcccggcagctacaggactgaggctccactttcttgctggctgtcagctgagggccatgctcctctccaagaggctcctgtagtccccttccacatgtgcctctcacatgcagaaggtcccgctccaggctgctaagatggggtcttaaataacgtaacacattggccgggcgcggtggctcatgcctataatcccagcactttgggaggc

SEQ ID NO: 332274 - DNA, 354 bp, Homo sapiens
attacacaagttcacctgtttgctatcatgtgacaaactagatacaaatccttagaatatgtaaaggttaatctttgacatggatactgacggccaaaaaatcattcatttttatttgtgccaaagctagttctgatttaacactaagaacatgactaagctaccattttagagccatataattttaatattttccacaatgccttggaaatagctatcactaaaatagtacccaaaacatcatgggtagataatgtttttaaaaatgttgactgaaaatacactttggtttgaaattccagagtaaagaacaggtaaagagactaaaatagctaagatgcattgtagggatga

SEQ ID NO: 332275 - DNA, 409 bp, Homo sapiens
aaaattcagagcccagatttcattgtttatatgatactgcctgatacttcctaaaggcttggtagatagaggggcctgagccttgaattccagctctgcctcttactagctgtgtgaccttgggaaaaccatgtaacatctctgaaactcagtctcctgagatctaaggtggaaataatactaacttctttaccaccaggttgttgagacaatgcaatgggatgtgcacagagcactcagcacagtgcctggcccctggtaggtgctcactaaatgctaattattgctaactttagtttccatgaggaactccatccccatcacttctgagaactgggggctacagaagtgtggaagcacatagacaaatgtaatggagaagactttgctgtggcttatggtacacttc

SEQ ID NO: 332276 - DNA, 433 bp, Homo sapiens
catgtgactacgtgctagtcattggcaaatgggtgtaacttccataacaagttttccctttcacctttttttccagctggttggaatgttacagtgacaagccacctagaacactgtgatgcaggcaacccttgtttaaccactgttttgtgggtctctaaaggaggaactgagctgtatcctgattggtacaatgttcaagactggttcagtgttgaacacacaataggcactccttttctccctgggaaagtgaaaaacagtcatggtctttgcctttttctccaattagagcttataattgagtgaggcagacacacatgaaaataattagccaaaaggtcaattataaatgtttaaaaaaaaaaggtctgggcacatcttcacagaggtctgtgtagcacaggtataagcatttgtagacctcaaccaa

SEQ ID NO: 332277 - DNA, 1926 bp, Homo sapiens
  misc_feature (1926)..(1926): n is a, c, g, or t
tagaggatccccggagacacttacgatactaaactaactttttagaatgtgttccatcttcttaccacaaacaatattgatattttcccaacttttaaaatacaaatttgtaacaaagggtttagccagggattcttagtctagggattcacgaatccccagaaatcttttggaaaatttccagaaaaagcaaaactacattttgctgtaagttgtctttatattagacagggctctgggatcatactccttccctttttctaaaatgctagtttgtgttttataattagaatataaattctgtgagatctgggacttgatctgattcatttgtgtctatagtccaagcacaatcctggcatacggtgaaagctcagtaaatattttttgaataggaaatatttgtatttattcatttctagtaattttcttaaggctgtccttaagtcatatatttaaaaattaatttgaggttactaattggtatgaaagtctgtatttatagagttttatactttcatgcaaaaagttcttcccttgaaaaagactcataatgcttttgaattagtatgccactgatcaagtagttgcacaagttggtaattttccaagggtaaagttgagcaggggggtgacctgtatttacccagctcctacttgtgtcaggccccttatttatacacacacagagtcataggtaatcttctcagcacccttcttttacacatgagacttacagagatgaggtagtttgcacaggtcacaaagctaaataaatcatgcagccagaatttgaattagtctgactcctattctctttacattattccatgtggcctctttaaggtagagattatgtatgtctgtaccccacctgtgtctaccatgcaggaaaaatcatttcccattcttttgtaaatatcatgtttatcagtcttaagatactctattttattgattgagacagggtctcattctttgtcccaggctggagtgctatggcaccatcatggctctctgtagcctcaacctcccaggctcaagcgatcctcccagctcagcctcctgagtagctgggattacaggcacacagcaccacactcggctaattttttgtattttttgtagggatagggtctcgcttcattgccagggctagtcttgaactcctgggctcaagttatcttcctacctcagcctcccaaagttctgggattacagacgtgagccactgcatccaaccacaagataatctgtttttaatggtaaatattttataaagttgttgaaaggaatgagttaagcccaattccttgtcagttatttttcacttaaatacacatatttatcttaatccaaaaacggtttaaggcattttgatcttagagaagggaaggaaaaacaggacagattagtctctttttgagcccaaaagaatctctgtattgttttcagattattaaattttgcatgcatttttctgttttactttaaacggataaatgcaatacccatagctgcttttacatttttatatcacagtttttagaactatgtgaatattagttttttcatatttactttttattcacttgtcaaagcattgctatggagaagacctatactgtttgaaaatgcaggccgggcgcggtggctcatgcctgtaatgccagcactttgggagggcgaggcaggaggatcacgaggtcaggagatcaagaccatcctggctaacatggtgaaaccccgtctctactaaaaatacaaaaaaaacaaaattagccaggcgtggtggtgggcgcctgtagtctcagctactcgggaggttggggcaggagaatggtgtgaacctgggaggtggagcttgcggtgagccaagattgcaccactgcactccagcctgggcaacagagtgggactctgtcn

SEQ ID NO: 332278 - DNA, 1694 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332279 - DNA, 3328 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagataccgagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaagctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332280 - DNA, 3420 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagataccgagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaagctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaaatgctgattgcatttagactagctacttcataaacagccccaccaagaaaagaaaatcgcgatcccgatataaaccattctagtat

SEQ ID NO: 332281 - DNA, 1524 bp, Homo sapiens
gagcattataggagtttaagacatgcaatgccttcagaacagtggctagtgctccataatgttagtgattgctcctgtcattttatttagggaggtttgcctcactaagcatcaattattatttttgtcgtctttttcagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332282 - DNA, 1220 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagtgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332283 - DNA, 1034 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgcctttgatgccctgggtcagttgaatggcggctataaacctca

SEQ ID NO: 332284 - DNA, 2477 bp, Homo sapiens
ctgagtcccagttcatcccatgctgctattttgctctcccaggagcatctggactccctagacagagccccagcttctcacctgtccctctctaaatgctgctctgcaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagataccgagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaagctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332285 - DNA, 2468 bp, Homo sapiens
ctgatacaggaaactagcatgtactagagcaaatagatatatacatgtaaacgtgtatataactaatataaaagattttacacaaataagattgatggccaggtgcaatgtaacctataaccccaccagatcgcgagttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagataccgagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaagctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332286 - DNA, 954 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaatcccgcttgttggtatttgtatatcttcatttgagaattctctgttcatgtccttagcccactttttgatgagattttttttttcttgctgattcgtttgagttctttgtagattctggatattagttggatgtatagattgtgaagattttctcccattctgtgggttgt

SEQ ID NO: 332287 - DNA, 576 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332288 - DNA, 1378 bp, Homo sapiens
aacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacacca

SEQ ID NO: 332289 - DNA, 3382 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagataccgagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaagctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332290 - DNA, 1596 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctgacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccaaaaaaaaagtg

SEQ ID NO: 332291 - DNA, 2158 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtaaacctcacactggttggcagaaggaactataccaataattagtgaacatgcggtgaatttgcaacagacaagaggagcctcattatcctatagtttccaggttgcttagggaggcagaaatcacagcaaggaaaaccttcaataataaacagacgtctcataaaattaattgcaacccaacctctctctctacttaaaattagcatctatttccagctctgctttcaatgccccatatgaatacatgtgaactccctccctctcttcctccctgtctccttctctctctctctgtccctcattaaaaaataaaatttaagaaaaaaatacaaggtagatttacacaaatagtgggatctcagtcttgagttagctgtgtatgactgaaaaggatgctgtggttaataattatcataaaaacaatgacatggccgggcacagtggctcacgcctgtaatcccagaactttgggaggccgaggcaggcagatcacttgaggccaggagtttgagaccagcctggccaacatggtgaaactgcatctctactaaaatacaaaaattagccgggcatcaatggccagcccctgtaatcccagctaatcaggagtctgaggcaggcgaatcacttgaacctgggggctggtggttgcagtgagccgagctcacaccactgcactccagcctgggcgacagagtgagactacatctcaaaaaaacaaaaacaaacaagcaaaaaaaaccccacagtaacacaaaagtaataaaactgctgctatttactcagtgcttatctgatgccagccactttgctaagcctatgaatgcattatttccccgttgctacagatgagagaattgaggttcagacaggttgaaatcattgctcccaaagtcacacaactggtgagtggcagagctgggatgcaaaccctaaactgccagccctcaaagcctgtgctcttaatctccaccctgctgtgcttcc

SEQ ID NO: 332292 - DNA, 1229 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggtatgctatccccacatggcttagctcccctatgtaaatgaacacctggatacaggtacagtgccttggaaatggaggaggtgggagggctccccacttagtgagaatctcctgttgcccatcattgtactgggcattttactactgccatctgttttaaacacctacctccaaccctgtgaggcaggcactatgccaattattttacaggtgag

SEQ ID NO: 332293 - DNA, 791 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtgagagctcccagcttctttttctccctcttcccatttctgagcagaaatctcccacagtttgagagctttttgccccaacagggcatctctctaaagcagggtgggaggagatcttaggatctgtcccggggcaagaatgaatacggtcatgatctatcacaggagagacattaaacagcaaattggcat

SEQ ID NO: 332294 - DNA, 541 bp, Homo sapiens
tccatgtgatgaagccgggttttccaggttcgaaactagcaggattcctcgccagcaagaacagatcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaaggtgagtccaggcctgcctggccaggggaggggtggctgaatgtgcaagagttgagattgagaatgagagagagagagagagagaagcaaaaacctagaacccagggtgcaaatgtgagtacagagagctgagatcttctgggatggtggtttcttatttatccacacagcatgttaaaatagattctggggtgaaatcctacatccctattattaacaagtgaccctcccc

SEQ ID NO: 332295 - DNA, 217 bp, Homo sapiens
ctggcccaactccctcatgctactgtagtgaggctcaaatgagatagcacccatgaacactcctgtaaaccatgaagtatgcaaacaccaggtgtaatagaagctgttaggtacctgtgaggccagcagacaagagcaagagatgctaatttaaaaagaattaaggtgaagcaaagatcttttccctctgccaaataacttggcaagagttgtaaaa

SEQ ID NO: 332296 - DNA, 526 bp, Homo sapiens
tccaagtaaaacaggtagtttgagaggaaactcagaaggcacagggtctgctgctgtctgtcctacagtgaggcatttcagagagcagggctcgcttgtctcgtcaccactacaggcaaagtgggcggcagccaggtctgatggagtgatacgtggggatctcgcagtcagccacattagcgtgctcccatctgccacttactggatgtgctcaaagtggggcagcggtcatggagaggagccctcaccacagagggtggacaatgagctgtttaccaggaaaagggaagcctccaagggcacatcatggccatcctaaaatgccccaaaggcaggcaggtggcagtgtgattttcagagcctggaggaatacattctatacttaaacaaggagttgtctctaagaggtgcgattctgagtggctgaaattagctcttatattctaacacatatatagaatgtaacctgttacattctcacagatctaagagatggaaagcttcctacatttatgtaagcccagat

SEQ ID NO: 332297 - DNA, 747 bp, Homo sapiens
ggagactcctggagactacagagtctgagaatgagttgaataggtgaggaggtggggctggtggaagtgaaggaggcagggaggggagagagcatgacctttagacctaacagcaataccaaaggtatgcttttcccagtgtatatcatttttctcattagggaaatgcctattttgctgttcttgcttcagatgaaggtccagggtcatctaaactagaaatttctccgtccatgccatgaaggcaggaaaaactaataaaacataatattatatatgcattgtcccgagttgctcatttttggaagacttggctgctggtaatccccaggaagtagaaacaacatgactgcctatcacctgtccacataattaatcacaactaatcaatagaagccaagatatggtgatttatcacaaaccctccacatttgctggtagtattttttccattttttcctttttaatattcttaaccagacagtgaagttgaaagttggtagttggctgggagctatagtaaaaagaaacccttggcattgttcctttggttgttatcaagtactcttctacttgactgtgtttcttctataaggtgagcaaggagcagagaagttagcactgagaagcttggactgggaaaagctgtaccttatctttggctcaatttgtttaatcagggacagtccttggggcaaagtcttagaagttggctcaggtcagaattttggctgcacagagagggga

SEQ ID NO: 332298 - DNA, 305 bp, Homo sapiens
accaggattcctccctgagtcattccatcccacacggccactcagctctgaactctaatgactgggtgaccccagggcctgctgcctgtgagtgtctcggctccctatgtcccattagctggcagagagcagggtccatctgcctcagttactctccaggtcactcagtgtcccctgcctggtggtcagttccatatattgatgtagctagttcatcatgctttaaattttttttttctgctttaatttagggacttaggggaagaacacatgttgagaagattcttggttcagcagcagtccct

SEQ ID NO: 332299 - DNA, 504 bp, Homo sapiens
caggatgctgggtccttcactgcagggctgggcatagcactgggcacttattggagtttcacagcttttgttgattgaataatgtctttcttcaggatctaactcaggaccttggtcctcattatgtgcacccaaggtttccagtctcccttcccaacaagcattaaacacattcatttctgatcacctcagcattcattgttggggccctgtagtgtgttgcccttaacagttaattacatatctgcatatatgtgcatgtatctatgtatgtttcacttgcatgcaagtttttcaggaatacgaacatgactgtgggcctctagcaggcagggccatgtctcatttctcccagccatcttccctctcacatccagttctagttcttgctcactcccgggcaccaacagatacttgacaaataactgtttatttagttagagggtatgggaatgattccaagtctgtaagaaagaatactcagtccattcatgccacaacaat

SEQ ID NO: 332300 - DNA, 5630 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggctggtctcaaactcctgacctggagtgagccactatatccggcctttataaacttttttgattcttgtcataacacttagcctaaaatgcaaatgtacagctgtagaaaaatactttatttctttatatccttattctagaagctttttttctattaatttttgtttgtttgttttgttttactatttacttctaaaacttttttgttaaaaaccatggcacaaacacacacattatgctaggcatacaaaaggtcaggatcatcagtctcactgtcttccacccccacttctcatcccaccattgtatctgctgtctgtggctgaccaaaacatcatcatgtagcacatgactagtgtggcaagtgctctgttagatgtaaggccatgatgctaaagcatcacaagagggcatctaacccagattggggatgtcatggaaggccgacatcctgagttgaatcctgcaaatgtaaaaaccaataggcaaagaagaggaacaaaaaggattccaggacaaactgaggtcacatctatgatccttgactttattgtgtctgtttaaagtatctacagtaacctgtatcaacttagtcagtgtattaatactaaatttagctccttcaaagcagttggaactatgtgctacataaatttcagcttcacacaaggaagggaaggagtgaaattagtgaacaggcagttacagcaaaagaaaaaacataaaaattgaatagctggctctggtgaaatgagcaaggactttagagtcaaactggcctggatttgaatcctgatcctcattgcttgtagctgtatgatctggacaaatgacagtaactgtttctaaccttgattttctcatctgtaagatgccaattgtaactcctaaggatactgaggattttttaaaatgcgtgtacagttcctgaccagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgattaaaagaaaaaaaaaaatcacagcccaggcatgtggctcacaccctggcacttggaggccgaggtgggagcatagcttgagcctagcagtttgaaactagcctgggcaacatagatcctatctctacaaaaaaaaaaaaaaaaaaaaaaaaattggcccggtgtggtggtgcatgcctgtggtcccagctactcaggaggctgaggcgagaggatcgcttgagccagggaggctgaggctgctgtgagccatgatcatgccactgcactccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaaaaaaaactcagc

SEQ ID NO: 332301 - DNA, 5745 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagagacagggtttcaccatgttggccagtatggtctcgatctcctgacctcgtgattcacccaccttgggctcccaaagtgctgggattacagatgtgagccaccacgcccagccagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggctggtctcaaactcctgacctggagtgagccactatatccggcctttataaacttttttgattcttgtcataacacttagcctaaaatgcaaatgtacagctgtagaaaaatactttatttctttatatccttattctagaagctttttttctattaatttttgtttgtttgttttgttttactatttacttctaaaacttttttgttaaaaaccatggcacaaacacacacattatgctaggcatacaaaaggtcaggatcatcagtctcactgtcttccacccccacttctcatcccaccattgtatctgctgtctgtggctgaccaaaacatcatcatgtagcacatgactagtgtggcaagtgctctgttagatgtaaggccatgatgctaaagcatcacaagagggcatctaacccagattggggatgtcatggaaggccgacatcctgagttgaatcctgcaaatgtaaaaaccaataggcaaagaagaggaacaaaaaggattccaggacaaactgaggtcacatctatgatccttgactttattgtgtctgtttaaagtatctacagtaacctgtatcaacttagtcagtgtattaatactaaatttagctccttcaaagcagttggaactatgtgctacataaatttcagcttcacacaaggaagggaaggagtgaaattagtgaacaggcagttacagcaaaagaaaaaacataaaaattgaatagctggctctggtgaaatgagcaaggactttagagtcaaactggcctggatttgaatcctgatcctcattgcttgtagctgtatgatctggacaaatgacagtaactgtttctaaccttgattttctcatctgtaagatgccaattgtaactcctaaggatactgaggattttttaaaatgcgtgtacagttcctgaccagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgattaaaagaaaaaaaaaaatcacagcccaggcatgtggctcacaccctggcacttggaggccgaggtgggagcatagcttgagcctagcagtttgaaactagcctgggcaacatagatcctatctctacaaaaaaaaaaaaaaaaaaaaaaaaattggcccggtgtggtggtgcatgcctgtggtcccagctactcaggaggctgaggcgagaggatcgcttgagccagggaggctgaggctgctgtgagccatgatcatgccactgcactccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaaaaaaaactcagc

SEQ ID NO: 332302 - DNA, 2634 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcgggctagtcggggggggatcctct

SEQ ID NO: 332303 - DNA, 5808 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtgagttgtcttttttttccttcccctctgtcacccactgatctgtcttaggacccctgctattccctgcacatatgctcacttcttagtgctgtgaaaatccagtgacttttataaatgaattttgagagcctccttccccccaaaatgtgttttttaatggtctaatttttcttaggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggctggtctcaaactcctgacctggagtgagccactatatccggcctttataaacttttttgattcttgtcataacacttagcctaaaatgcaaatgtacagctgtagaaaaatactttatttctttatatccttattctagaagctttttttctattaatttttgtttgtttgttttgttttactatttacttctaaaacttttttgttaaaaaccatggcacaaacacacacattatgctaggcatacaaaaggtcaggatcatcagtctcactgtcttccacccccacttctcatcccaccattgtatctgctgtctgtggctgaccaaaacatcatcatgtagcacatgactagtgtggcaagtgctctgttagatgtaaggccatgatgctaaagcatcacaagagggcatctaacccagattggggatgtcatggaaggccgacatcctgagttgaatcctgcaaatgtaaaaaccaataggcaaagaagaggaacaaaaaggattccaggacaaactgaggtcacatctatgatccttgactttattgtgtctgtttaaagtatctacagtaacctgtatcaacttagtcagtgtattaatactaaatttagctccttcaaagcagttggaactatgtgctacataaatttcagcttcacacaaggaagggaaggagtgaaattagtgaacaggcagttacagcaaaagaaaaaacataaaaattgaatagctggctctggtgaaatgagcaaggactttagagtcaaactggcctggatttgaatcctgatcctcattgcttgtagctgtatgatctggacaaatgacagtaactgtttctaaccttgattttctcatctgtaagatgccaattgtaactcctaaggatactgaggattttttaaaatgcgtgtacagttcctgaccagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgattaaaagaaaaaaaaaaatcacagcccaggcatgtggctcacaccctggcacttggaggccgaggtgggagcatagcttgagcctagcagtttgaaactagcctgggcaacatagatcctatctctacaaaaaaaaaaaaaaaaaaaaaaaaattggcccggtgtggtggtgcatgcctgtggtcccagctactcaggaggctgaggcgagaggatcgcttgagccagggaggctgaggctgctgtgagccatgatcatgccactgcactccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaaaaaaaactcagc

SEQ ID NO: 332304 - DNA, 2827 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaaaaaaaactcagc

SEQ ID NO: 332305 - DNA, 456 bp, Homo sapiens
ctatgtgtcataccatgtagtaatgtagtttactgtgatggttctgcctcacttaggtgattgtgattttctaaagggcagagaccatgtctaatgcatctttgtgttcctagtgcctcattatttgatacacagtaggtttcagtaaatgtttattaaactggtggtagggttatggaaagtaaatatacgtagaattttttattcaatttttcttactttgctctttacaggaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagt

SEQ ID NO: 332306 - DNA, 265 bp, Homo sapiens
gggttcaagtgattctcctgcctcagcctcccgagttgctgggactacaggcatgcgccaccacacccagctaatttttgtatttttagtgacagggtttcaccatgttggccaggctggtctcaaactcctgacctggagtgagccactatatccggcctttataaacttttttgattcttgtcataacacttagcctaaaatgcaaatgtacagctgtagaaaaatactttatttctttatatccttattctagaagcttttt

SEQ ID NO: 332307 - DNA, 2025 bp, Homo sapiens
  misc_feature (1)..(4): n is a, c, g, or t
  misc_feature (1569)..(1569): n is a, c, g, or t
nnnngttgtttggatgtgtatatgcgtgtgacatgtgtttcttctttctctaactgataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatgtgagtatgaagatctagaatgcctgtaacattccttcctctgtgtgtttgctcattctcttccctctcttcttgaactctttctttccaccttatctcccctgttaaaatccttcacttccttttaaggttcatcaaatgcctgtgcctccataaaagttgtcttgatcactccatctagatgtgatcttcttccttttctagtaccctttcccccacactgcagttcttccatggtatttggtgtgttcttttccttgcaacatttattttacattttaaactactttgtattcgcaccaatcatatttatctttttcattttactagtgtgtaaccccttggagaatggggattatgttctattcattcatacattcattatttagtttataatgcccaggaactactccagaaatacaaatgctttctaaagttcttgtacataaactgacttatttttccgaatactttttattattaaagtatactttacatacaataaaatgcatagatttttaagtgcccagtttagtgagtttcagcaatgcatgccctgtgtaaccactattccagtgaagatagagaacatatgtattaccccagacaattttcttgtgccctttccattcagtcctcaccctgcccctgctcagaggcaactgctattctgatttctactgctgtatattccttttgcctcttctagagttttatatgagtggaatcacacattaatcttttatttctggtttctttcactttgcgtaatgctttgagattcttctgtattacatagagcaatagtttgttaccaagtagtattatgttgtatgaatataccacaatttgttatccagtcacttgttgatagaggtatggattaacttaggttttcggacgttaagtttttctgaggtttgtttctgtagcaataagagttgggttttttccccatgtaaccgagatggccttcagttctggtttccaaaggatntaagataccttttcatctctatactagtccttttcattttctttgagagatgaaatgagaatacattcatacatttaaatgatgctgttgacttatgttatagtaaatttgcttttaatttttgtttaagattgtttctgtcatggctttagcttaaagcttaaaaaatcacagtgggccaggtgcggtggctcacgcctctaatcccagcactttgggagaccgaggcgggcagataacgaggtcaggagttcaagaccagcctggccaatatggtgaaaccctgtctctactaaaaatacaaaaactagctgggcatggtggcgtgtgcctgtaatcccagctactcgggaggccaaggcagaagaaccacttgaacccgggaggcggaggttgcagtgagccgagatctcgccactgcactccagcctgggtgacagagtgagactctgtgtc

SEQ ID NO: 332308 - DNA, 4449 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggttgtctgagctcaggagtttagagaccagcccgggcaacatggcaaaaccccatctctactaaaaaaaataccaaaaaaagttagccgggtgtggtggcatagtcccggctactcaggagtctgaggcaggagaatagcttgaacctgtgaggcggaggttgcagtaagccgagatcgcgctatccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaaaaaaaactcagc

SEQ ID NO: 332309 - DNA, 3824 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgccaccacacccagctaatttttgtatttttagcaacatggcaaaaccccatctctact

SEQ ID NO: 332310 - DNA, 1562 bp, Homo sapiens
cgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaaggtatatttgtattaccttcttgaattttggtaaagtttgccaagtcttatattactagtgggaggctattacagtggtagcactgtatcatcatcatcttggctcgtattcagtaatccattggtaaattgataagaaagtacattgtgctaactatatgatcatcctgcatcgtatttagtaatctaggagtaaatggttaagaagcgtgttgtcccagctcttatcccaagggacagaagcttgcctctcagaatatggtaagttgtcttttcgcagctcagattaggctaggaa

SEQ ID NO: 332311 - DNA, 204 bp, Homo sapiens
gtgtgtacgagctaagattattaaatgtagggagagtaaaaggcaagtgaaaagaaaaaaaggaaaggaagttttcccatagaggtaagaatggaaataagttttgaatgattacagataggcaaggttaggagaatagaagtatcactctaggcagagggagagaacgtatgcatggagacatgaatgagtcggtcatatctg

SEQ ID NO: 332312 - DNA, 391 bp, Homo sapiens
cactggggccacacctacagctgggacaagtttgccaaccacacagtgagaggggcaaactgaatgattcgtattccttaggggagaggagcacgaccttagagattgcagtcagagacatggtggggcaggacacacagctgcaccaccaggccaggtgaggatgacaagttcacataaattgcagtctctgaaatgggtggcagggatgtatacacaagaataagaagtcacaaacgtcagagtggaagcaaagtagagagcatatggatgagattttcaaaaggatgaaatagaaaggattttgctggcagggtctaccgcagtcttctcaggcagagcgaggctctggctcatgctttcctatttaagattttttaaactggcacag

SEQ ID NO: 332313 - DNA, 520 bp, Homo sapiens
tgtgtggaggatagatatggttgagggcagaggtagtggtgcaaggcatggacccagagggatggaggccacttagaaggccattatagtcacacaagtgagataatgagaatttgaactaaggcagtgaggatggagaagaggggccatattcaataaatatgtagagtgtgatattggcaagaggtagtgcttgattgatctaaagtaagaaagccagaggagttgaggacaatacccacattttaatcctttctgacggctgggcacagtggctcatgcctgtaatcccagcactttgggaggccaagacaggtggatcacctgaggtcaggagttcgagatgagcctggctgacatggcaaaaccccatctctactaaaaatacaaaaattagcctgacatggtgacatgcgcctgtaattccagctacttgggaggctgaagctggaggatcacttgtacctgggaggcagaggttgcagtaagccaagattgcaccattgcaccccagcctggg

SEQ ID NO: 332314 - DNA, 588 bp, Homo sapiens
tgttcattccccaggctggttctttcataaacgctgtctgcaggaatgaaaggcatcgcctatggaaagggctaagaggaagaggacactcccatgtgcggtgggagtaatggcccctccgtcttcctagcagttcactgaagcctgaagcagtgagaggctgctggatcccactgtgcttttgttaaagccctgtccccacatgctgttcttggcttgttatagtggcacgcagttcacttccagagactccccagccccaaacacgtatagcgccaggtgaatggaagtttcctccagtgcaactcctggatgggtctgagaagggaagcaagaaccaggatgtgactcaatggtgaacttacgactcggccctgggggtgcagcgtgcacatagataccatggagctaggtgctgacattgtaaaaagtggacccctgtccggaagactttcattttctttcggcagttcttaactctcttccttggtcacatttgaggagttgccctgttggtaagctcaaggtgccactcagccagagagtcctcctgggcatgtgaactgtgcggtgacctgggaccccaca

SEQ ID NO: 332315 - DNA, 305 bp, Homo sapiens
ggaagtggggaagatgagggagggataggcgagaagggaagggcttctggaaggtgagagaaggaggagcagcaagcagcaggcagagaagagagggcaagtccaaacaaagaagaacacaaacaatagaagggctggctatcaagaagatcttttctttgggggccaatgccatattccagcatgggcaggaaaccacaacaagcctttctgagcctcactctgagtgtctaggcttgtgggaggtgtagaagcatgacacgcagcctttgtcccacaggggcttgcaactgggctgaagggct

SEQ ID NO: 332316 - DNA, 270 bp, Homo sapiens
tctcagttagttggacagagtggttcaccaatgcgtgtcctgtgcctagtacagagtcaggcattaaataaaggtttgctgagtgaatgaatattaagaatttacttcccatatcatggtgaagctcaggtctactggtattgcatgcaagtcattctttggaacatgaaaataattctttgggatactggcacagaatgcaactgcacctactacttgatagcacaacagggtgactatagtcaataataatttaattttttttttttt

SEQ ID NO: 332317 - DNA, 377 bp, Homo sapiens
cttttaaacagacctgggaaaaacagaatcaagaaatttcaaccaataaaacacaactctttactggtatgaaagtaaagtaaaattcagtaatgaaaggaaggaagtctcttaaacatttactgcattccaaagcttggaattgtggtttattgctgaggtctcttctgatgtcccacagtgctcctgctccagcatctttaatgaagtcccataaactcccataaaatcctcgatcgttgacaaatcatacacacacgcttagggcaaggctcactggatcacgatgctctcttcctgaatgaatgaaatttacaagtcacagcatggacagtgtcgccaagtggcccaagacagaacagggatggacaaacaac

SEQ ID NO: 332318 - DNA, 231 bp, Homo sapiens
aaaattcctttcatttactcagtaataaacaaatccaaggcaatgtaaatgatgttttcaactatctccttttatctataatctgccttcaatagtgatgatgtggtgtattccagctctgtgggtattaagatggttttgtgttcattatttttgcttgtgatgagcaatatgatggaaacctagagagaaaattgacccccaaataaaaacctctttcaatatggtagt

SEQ ID NO: 332319 - DNA, 390 bp, Homo sapiens
caaggtgggcagatcacttgaggtcaggagtttgagaccagcctggccaacacagtgagaccccgtctctactaaaaatacaaaattagctgggcatggtggcgggtgcctgtaatcccaggttgctcttttttatttcgataagcaaaggtaaagggaattccccagatgatattagagggaaagatggatagttttgtgagatgatcagtcagatcagacataacaaatcatcatcccacaaacttaaaggctggaaacaacaatcttcacttatgacacctcacaggttcataggaacaccagatagggaagagtagggatgaccttctctgcttcaccacgtctgggagctgacctggaagatccaaaggctctactgaccctggc

SEQ ID NO: 332320 - DNA, 294 bp, Homo sapiens
ttaaaattttttaagcatttttcaatttggtatttgatttactcacatcgcccatggcttggaggatagaatttaaagtcagacaaatctgggtttgaatcagacttgacactagctgtgggaaattgggcaaatcacttcatctttctgaacctcagttttctccttggtaaaatgtaagtcatgatgcttgtctcaaaaagttgccctgaaggttaaataaggttatgtaatcatgttagatgttaatgcatactatatacttgtttaatttacttgcagcatttctatgaa

SEQ ID NO: 332321 - DNA, 470 bp, Homo sapiens
ccagaatgagtgctcacaaagtatttgctgaatgacctaataaaagctcgatgaaatggaaagacttgcccaaagtctcagaaatagctatggctgcaccaaagctaaaaagagggtcttctgccttctaccgggtgacctttgtatccctctacactgtgtcctcctcttcccctcctcacactcactcccctgcctccctctggaaccatcagcctctgtccacttgtggactctggtcccacacaaaccccgcctcccagtcagtagaaagagtgtcaaaagcaacacgtttaccttacgtcttatccctcacctgtaataccacctccttaatatcaccctactgagaactaggcaggccagaaattctgcagactgaggcccacgaaagataatctagagaattaacaggaaacaaacaaacaaaaaatgtggatctgaatcttcagagtcaggcccagagctcc

SEQ ID NO: 332322 - DNA, 424 bp, Homo sapiens
tctttgctctgtttaacaaaaatatagtagatgtctatgtatacagcactgtgcaagggctaagaggaataaacagaagtaaactgcataaatcctgccctcgagactcaagagcagataaacacatgaagttaaataatacaaaaaactactaaagagttggtatcacacaacataaagtcaagagggacaaaagatatcctaaaaatgagtgcccatgagaacaaagcatgagcttgggcttgaaagacagtgggaatgatgaatacagagggctcaagaaggcctgcagtgggaatatatgagccaagggcttctctcttgctcatttctgtcccttaactcatgaccctacaactttccacatatgctttggttctaagctttacaatcagatccaaggggacactgccccctccttggc

SEQ ID NO: 332323 - DNA, 344 bp, Homo sapiens
gtgccgaggtcctgaatggcatcactgatcagaatggagaaacatcatctctctagacacagagtgtggcagaaagagacaacttcccctgttgggtatagaattgttactggaacgtggctcctagccagtaacaacaggttcccagccttccctgcatccggcgtggccatgtgactattctcaccaatgaagggtgagcattattgatgtgtctctcccacaccaaagcagccaagaagaaggtgtgcctcctccaccctctcccctcttccgctggctaagcagagaagactgtgaggccccagaggtataaaagaggctccaggatatagaagaaaaac

SEQ ID NO: 332324 - DNA, 542 bp, Homo sapiens
aacaatgtgtttacttttgtttttccatttcttagcattttagaataaacaggctagaaatagaactttttgctttctttcccttcagagaagggccccaaataaaaatacccgacttttaccagctagaatgcaactattgctcatgttatgtgaagaacgtgtggctccaagaagacaacattgataaaacaggaacctaaattaactttcatcacctgaggcctcaatgttaattctgagatgagattaataattgtgatatggctccatgcatgcactgaggtaccatgagaggcagtgtcacctcagttacctgaaccatagacagaaacctcaagttacccaaagcataaagggacagggcggtgttacggagattaagaaaggaggagatgattggccagcagtggtggctcacgcctctaatcccagcattttgggtggctgagacgggcagatcacagggtcaggagatcgagaccatcctggctaacacagtgaaaccctgtctctactaaaaatacaaaaaaaaaaaaaaa

SEQ ID NO: 332325 - DNA, 525 bp, Homo sapiens
tctcaacaacaacaaaaaggaacgacagtaacagagccaggcatagtggtgcatgcacatggtcccagctactcagaaggcttgtgcccaggagtttgaggttgcagaaagcagcctgggtgacagagcgagaccttgttctaaaaaaacacaaacaaaaacaaaacaacccaccaataacaataacaagggaaaataccgttaaaaaacaggtttcaaaatgttattatttcatttgggtaagaaaaaaacatgtgtgcctgcttacataagtataaaacatatcacagggccaggcacggtggctcacgcctgtaattcgagcactttgagaggccaagtcgggtggatcacctgaggtcaggagatcgcttgaacctgggaggcagaggttgcagtgagccaagatcacaccattgcactccagcctgggtgacgagagcgaaactctgtttccaaaaaaaataaaaaataaaaagccaaaataaagtaaatcaccacctcccagatgagaccgcatatcgg

SEQ ID NO: 332326 - DNA, 140 bp, Homo sapiens
aatgtgctggtgccttcaccctgaactacccagcagacccctaggccacagacaaaggacacagcttcccccttggctccacccatctcttctgctcttctgttacacacatccatgtgactagcctcaatcagcccaga

SEQ ID NO: 332327 - DNA, 723 bp, Homo sapiens
taatcccaggattttgggaggccaagacaggaggatacctggagcccaaaagtttgagaccagcctgggcagcatatggagactctcctctataaaaaaaattaataatagccaggcatggtggtgtgcagctgtggtcccagctacttgggagattgagggggagtcaaaattgtgccactacactttagcttaggtgacacagtgagaccccgtctcaaaaaaagagctgttcgtttcaggcatgttaattatattcacactgtcatgcaaaaggcttctagaaactttacatcttgtaaaactaaaactcaatgcccattaagtaacaactgctcattttacactctttccagcccttgacagacaaaccttctactttctgattttatgattttgactacttaagatatctcatataagtggaatcatacagtatccataattttgttactggattaattcaggtggcataatattttcaatgttcatcttaaaatgtgacaagattattctttttaaagtggaataatattccattgtatgtgtatgttatattttttgatgtgtttataaatcaagatatatatggtggtttagccttttggcttttgtgaatactggtacaaaatacatgtattttcaattatgtcttccaggtcctgtgttgcatattttgtttttttgttgttgttttctttctttctttctttctttttcttt

SEQ ID NO: 332328 - DNA, 463 bp, Homo sapiens
agaggtgacatgcccttgcatcacttaatataaatgggtacatgatatccacctgacttatcactagtgatattaaccatgatcacttggttaatatcacttgtttaaggtggtgtctgtcaactttctccaccgtaaagttactatttttttccctactctaatctttagaaatgaatcattaagtccagtccacactgaaggggatgctttatttattccttatttgaaaaaattttttttaacttacagaaaagttacaaaaatcctacaatgaattcccatatacacttcatctagattcaccactgataacattttccatatgtggtttatcaagatctctcctgctccctctacaaatatacatattattgctattcatatgactatttgaactgaaacatttgagagtaaattgaagacatcataaccttttgtcccatatacttcatcatgtata

SEQ ID NO: 332329 - DNA, 498 bp, Homo sapiens
caagtattataccatatgcttcccatatagttgtgtcttttcatccttataaccacactacaaagcagttacaagtatcccactgtagagtaaagaaaacaaagctcagagcagttagggatgttgtctgaactcaccaagttggaatgaaaagtatgggccttgaaatgtcagcccaggtctgcctgaccctgaagcccaagttctttctgctctgcccagtgacccagaaagggccagatagtggactctggactgaacacaaggccaacactcctagatgccagctgtccaactggatttattcaacaaatagctatgaagttcctgctctgggccacacaacttgcctgaagagctagaaacagaacagagtcctctggaggtttttgagcagatgaaagagagaatcaaaggagaaattttagaaaattaatccagtgcctgtcaacctaaaataatcaaaaggctcaggatctggttaaaaagagttttttc

SEQ ID NO: 332330 - DNA, 308 bp, Homo sapiens
  misc_feature (288)..(288): n is a, c, g, or t
  misc_feature (291)..(291): n is a, c, g, or t
  misc_feature (294)..(294): n is a, c, g, or t
gaatcagaagctacattttaataaaatctccaggtgattcataggaatattaaagtttgagaagcactgtcatagagtagatgttaggagtgagtataatagatgggacattgcctggactttgaattacttccaaaacttgaagtggtggtagtctctcagcttccacaggccactcctatcccccacagggaagtggtggaatacatggtccagcatttcaagcctcagatctttggtgatcgcaagccaaatcggggagagatgggaaatgcagaaagaaccaanaancanaagagggggggggg

SEQ ID NO: 332331 - DNA, 513 bp, Homo sapiens
agttcgacggagactctcaaatctgtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggagagtctcagcagatct

SEQ ID NO: 332332 - DNA, 257 bp, Homo sapiens
  misc_feature (39)..(39): n is a, c, g, or t
  misc_feature (59)..(59): n is a, c, g, or t
tttttagaaatagaagccactgttgtctttataaaacanagaattgtgctgctgctgcngctgctgctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332333 - DNA, 372 bp, Homo sapiens
cccggccaggactgctgtcgtaataagccctgagtacacttgcaggttgcttataagaagagtgctttatgacattggtagttttgcatctgcctgttcatgggtgaattatctacccagccatattcttaacagtgatcctgttcccctattatcagccatcttctctgcccagcctgggacccctcaccttcctatcttcccagggcaccagccgaccatcccattactatgttctttgggatgacaaccgtttcacagcagatgagctccagatcctgacgtaccagtaaccaggaggcgatctcaaagcagaacttcgcctatcactcacagaagatcaagatccagaacatctccggtcacacgaag

SEQ ID NO: 332334 - DNA, 7329 bp, Homo sapiens
  misc_feature (656)..(656): n is a, c, g, or t
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332335 - DNA, 7276 bp, Homo sapiens
  misc_feature (656)..(656): n is a, c, g, or t
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332336 - DNA, 8090 bp, Homo sapiens
  misc_feature (656)..(656): n is a, c, g, or t
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggagagtctcagcagatct

SEQ ID NO: 332337 - DNA, 7240 bp, Homo sapiens
  misc_feature (567)..(567): n is a, c, g, or t
gaatcagaagctacattttaataaaatctccaggtgattcataggaatattaaagtttgagaagcactgtcatagagtagatgttaggagtgagtataatagatgggacattgcctggactttgaattacttccaaaacttgaagtggtggtagtctctcagcttccacaggccactcctatcccccacagggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332338 - DNA, 6091 bp, Homo sapiens
  misc_feature (656)..(656): n is a, c, g, or t
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggaga

SEQ ID NO: 332339 - DNA, 859 bp, Homo sapiens
cggtaccctccccgtacgcccaatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332340 - DNA, 1018 bp, Homo sapiens
  misc_feature (39)..(39): n is a, c, g, or t
  misc_feature (59)..(59): n is a, c, g, or t
tttttagaaatagaagccactgttgtctttataaaacanagaattgtgctgctgctgcngctgctgctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggagagtctcagcagatct

SEQ ID NO: 332341 - DNA, 371 bp, Homo sapiens
acttagatccctacatccaggaatttgggatcaaagtgaaggatgacatgacggaggtgacagggcgagtgctgccggcgcccatcttgcagtacggcggccgggtgagcagggtcagggccagacaacatctcggggcatatgggggtggttgggttgtatagccaggggcttttgctcccctacccacctgactctactgaggctcacctaggcgccccctctacctatccccagaaccgggccattgccacacccaatcagggtgtctgggacatgcgggggaaacagttctacaatgggattgagatcaaagtctgggccatcgcctgcttcgcaccccaaaaacagtgtcgagaagaggtgctcaa

SEQ ID NO: 332342 - DNA, 7471 bp, Homo sapiens
  misc_feature (798)..(798): n is a, c, g, or t
actggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332343 - DNA, 7158 bp, Homo sapiens
  misc_feature (656)..(656): n is a, c, g, or t
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgtggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332344 - DNA, 4682 bp, Homo sapiens
acctgggtcatccatgggctaggatcccatggatgggcacatgccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttcta

SEQ ID NO: 332345 - DNA, 2883 bp, Homo sapiens
  misc_feature (567)..(567): n is a, c, g, or t
gaatcagaagctacattttaataaaatctccaggtgattcataggaatattaaagtttgagaagcactgtcatagagtagatgttaggagtgagtataatagatgggacattgcctggactttgaattacttccaaaacttgaagtggtggtagtctctcagcttccacaggccactcctatcccccacagggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgangtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagataagaaaattgaagcccagagagatcaagtgactgatccaaagtcccacagtgaggggaactgaagataggatattctttctccttttcctctttaaaaaattattttgattaaaaaaaaccgtattactgaagcatagggacatggggagaaattatgaatgattcctcagcctgaataaaatagtatgtttcattaaggcaacaaatatttattaaggacctaatatttgcctgacattcaagtgaggtggggggcacacaagtagtaaataaataacagactgggcaaagggctaccaaggcaatactgtagtagactaacaggtgccccaccatagatgggtggtccggaaaaggcgtctcagatgtctttcgttgagacgcaaaaaaaagctgtggggtagggcgtaaggggagggtggagaagagagagagggttcctggccaagggaaccaaaagcagagaagctccaagtcagaaaaaagcagcggttggcccgttgggagaattggaagccaaccagtatagctgtagcacaggcggggcccatttacgccgtgcgttttcaccctggaaaggagtttgggttttcaagtgtgacgaggcgctattaaagagttttaaacatggaa

SEQ ID NO: 332346 - DNA, 166 bp, Homo sapiens
gcttcactaactcacaaaagctgttttgctgaattcttccttctaaatgcctttggatagggaagacacgtaactggaaagacaaacattttgcactttattaattgggtttttcattctagaattcaagccaagagtttgggctccggagtgagactcacagggg

SEQ ID NO: 332347 - DNA, 369 bp, Homo sapiens
ataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtg

SEQ ID NO: 332348 - DNA, 986 bp, Homo sapiens
tagtagagacagagtttcaccatgttggccaggctggtctcgaactcctgacctcaggtgatcctccggcctcagcctcccaaagtgctgaggtaagccacaccatacgcgtgagccaccatgcccggccctacccttagtcttgatatatcagaaaagcactgtttgatgtgcttcagtgtaaaccattgtggttcggtgaattctggcaggtcatctggaggtttctttggagagcttctatcctactggaaacccaggttgggccccatgtggattgatcggcagtgggaatcagctagggctgctgtaactgagttcgcagacccagtggcatagacagcaaagaggtactgccacgtggctttggagaccagaagtctgagaggaaggtgctggcagggctggttccttctgaggctgcaatggaaaacctgtcctggcctctctcctggcatctgctggttatctttggtgttccctgtagacagctgccccctccctgtatcttcatgtcgtcttccttctctgtgtccttctcttcacgtagtctttttaggacgctggtcgtgttgccttagggcccccatgtcagtgccgtcatctagactgatgatgcccgcagtgatcctgtctccagataaggtcatgtcctgaggtgttctgggttaggactttgacgtttgaatggtggggggtggtggacacaattcagcccctgacagcagcttttctctcccctccctgacgctgtcgcagctgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgca

SEQ ID NO: 332349 - DNA, 285 bp, Homo sapiens
tactactactactaaattcgcggccgcgtcgaccctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgca

SEQ ID NO: 332350 - DNA, 307 bp, Homo sapiens
tactactactactaaattcgcggccgcgtcgaccctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcaagaggactcttgtctgtcagca

SEQ ID NO: 332351 - DNA, 1143 bp, Homo sapiens
tgctcacactgtatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgtggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgctgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcaaaaaaaaaaaaaacccaaaaaaaaaccggggggcctttttgtcggggggggaaaaaggcggtttgaaggggcctggccatgtgtcccggcccgcttttggtcaagggggaaccggcggcccccaaaggggggataatcaaagcggtcgaaga

SEQ ID NO: 332352 - DNA, 796 bp, Homo sapiens
tgctcacactgtatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgtggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgca

SEQ ID NO: 332353 - DNA, 1039 bp, Homo sapiens
tgctcacactgtatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgtggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgctgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagtaagtacttcagtccctggagctgctgagatcccatagccccagcaagccgtgatgggggacgggtgggtcacccatgtgggcccagaacacacacgtgtggcccctgatgcagtgccatctggcattgcctaacgggacatggtggcaatagatgcttggcccaactttagtggttagtaatcctctctaagggaaagctgaacctcacagatgacctgctctgtatccggctctagtccctgtcttcagccacttcctgttctgatctttga

SEQ ID NO: 332354 - DNA, 991 bp, Homo sapiens
tgctcacactgtatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgtggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgctgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgca

SEQ ID NO: 332355 - DNA, 1035 bp, Homo sapiens
tgctcacactgtatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgtggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgctgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcaaaaaaaaaacacggcacaatagaaataatatatcacccaaacgg

SEQ ID NO: 332356 - DNA, 913 bp, Homo sapiens
tgctcacactgtatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgtggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgctgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgcagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgca

SEQ ID NO: 332357 - DNA, 395 bp, Homo sapiens
agtcattctagaggactgggcggggagatggtgtcttcccggccgggtggcactgaccggtcatgctcagggcccccttctggttgccggtgcctcacctctggccaggtggcatcggcttccgggtaaatctgagctgcccaaagcgagcctccggaggctgctccatctcctggaacgtttactcattcaggcctctggacgtcgatactggggatgaaaagttcagaaagtggacagattcctggtcttcagtccagacctactgagttaaaatattgaggagagatggagctcaacagatgccctaggtgactctgatgtggcctaagtctggggaaacagtacaccctgcagtacttctccaacctaacagaaatgcggattctgattcg

SEQ ID NO: 332358 - DNA, 403 bp, Homo sapiens
caacctctcttctgagtcttttacatagactgattcatccaattctcacaacagtcctggaaacaggtttattagtatagttactccaactttacagggattaagtaagaggcctgaggctacggagctagagaaatcagtctctgcacaaacacattatgtctgatgggggatggaggaggtggagagagaagcagacagaaagagtgagtgtggctgaatagatagcaagaagtgagattgtagggtacaagggaggttttgttttcattttgtttttaaataaaaacaaataaaacataagtctgtgagaagcatctacttgagagaaaagccaaatatagaaaaagagtggggtagttaatattagtaagattttgtaataacagctacttagaagagg

SEQ ID NO: 332359 - DNA, 781 bp, Homo sapiens
atactttaaaagccttttgccagtgagcattctttattccttttaatatttagccaccttgcaatattgccatctttaagagggacaacacagaaaccagtgtacagatttctttgtagttactattgagatttattcctgtaaatctggcttttgtaaggaattagagatttaacctctaaggttgtatggaatcagaaaccaattcgaggctctgtggctgggatggggatgaaactgtacatttgagcttatcactatcctgcccattatgccccaccatcaagtgaagatgtgcaggactgccatagaggtgctacaggaagtgaggactatgtgaggagacccagaaatgcagaaaaatgttttagggttcccagtaataactgtgattagcaccttctttattttgattccccaggtgtgctggagaattgacagaaaatactccaaatagggtatttggaatggcattagaaacacacttagggccagacattgtgcctcacacctgtaattccagcacttttggaggccaaggcaggaggattgcttgaggccaggagtttgaagccagcttgggtaccatagcaagaaaccatctctataaaaaatatttttaaaaattagccgaacatggtggtatgtgcctgtagtgccagctattcaggaagttcagtgggaggatcacttgagcccaggagattgaggctgcagtgaactgtgatcgcaccactgcattccagcctgggcaatagagtgagatcctgtccttaaaaaa

SEQ ID NO: 332360 - DNA, 812 bp, Homo sapiens
atgaatgcttgtgcgttgatagagggaacatactttaaaagccttttgccagtgagcattctttattccttttaatatttagccaccttgcaatattgccatctttaagagggacaacacagaaaccagtgtacagatttctttgtagttactattgagatttattcctgtaaatctggcttttgtaaggaattagagatttaacctctaaggttgtatggaatcagaaaccaattcgaggctctgtggctgggatggggatgaaactgtacatttgagcttatcactatcctgcccattatgccccaccatcaagtgaagatgtgcaggactgccatagaggtgctacaggaagtgaggactatgtgaggagacccagaaatgcagaaaaatgttttagggttcccagtaataactgtgattagcaccttctttattttgattccccaggtgtgctggagaattgacagaaaatactccaaatagggtatttggaatggcattagaaacacacttagggccagacattgtgcctcacacctgtaattccagcacttttggaggccaaggcaggaggattgcttgaggccaggagtttgaagccagcttgggtaccatagcaagaaaccatctctataaaaaatatttttaaaaattagccgaacatggtggtatgtgcctgtagtgccagctattcaggaagttcagtgggaggatcacttgagcccaggagattgaggctgcagtgaactgtgatcgcaccactgcattccagcctgggcaatagagtgagatcctgtccttaaaaaaaa

SEQ ID NO: 332361 - DNA, 555 bp, Homo sapiens
gggcaatgtagtgaaaatcctgtctctacaaaataaaaaaatatatataataagttgggtgtgatggcttgtgcctgtagtttcagctactcaggaaggtgaggcaagaggatcacttgagccctaggaggtcaaggctgcagtgagccttgagcgtgccactgcacgccagcctgggcagcagactgcgactgtctcaaaaaaaaagaaagtaatttgagctggttatcagaagtaaattacaaagcgaaagcattttctaagcatcttcactgtgtggtaaattactgtggttctaactgttttgtgttagaacatgagtaaggtaagcagaactttgcaaataacaacatgtcagaagtttcaattattaattataatattatagtatagtgttgggagtgggaaattcaattcttatcactaaccttgacatggatagaaaatgatgtgtgcgtgtttgtgtgtgtaaattcaattatgttgttatatatgtctcaccataattgtagtttctctctaatgattattgttataggtaataaataggaaaaa

SEQ ID NO: 332362 - DNA, 228 bp, Homo sapiens
ggctttattcagctgggagcaccggcagactcacgtctccaaaaactgagctccctgagtgagcagttcctgtcccttttaagggcttacaactctaagggggtctgtgtgaaaggatcgtgatcaattgagcaggcagggggtacttgactgggggctgcatccactggtaatcagaacagagcagaacaggacagggattttcatgatgcttttccatgcaatgtc

SEQ ID NO: 332363 - DNA, 547 bp, Homo sapiens
cggattcacagcactggcctcatcattatatctgataatgatgcacagaaaacctgaatagagaaaagaagaaagataattcattggcatgtgcttgccaaaaagagactttatataacttgagaaagcataaagacaacctggaatgaggaaatgtatgtacagtaatgaaaaaaaaatgctttaaacagctgtgtcaaaaactgacatcagagagtaaattgaatttggttttgtaggaagcaggaagcaagcccactcaaacgttgaaatttggcatgagggagtccagtaactttctcctcaatctgtgaactatatgtgagtttgatattttgaaggaaaaggaaaaaaaaaagtttaaaagggcttctgcacagcaaatgaaactagcatcagaatgaacaggcaaccaaaagaatgggagaaaaattttgcaatctacccatctgacaaaggtctaatatccagaatctgcaaggaacttcaacaaatttacaagaaaaaacaaccccatcaaaaagtgggcaaatgatatgaacagaca

SEQ ID NO: 332364 - DNA, 593 bp, Homo sapiens
ataagaaggagccccagatcatggcaattcctgctagtcaggatcagctaaccattacctgcaggtcatacttttccctattatcaagggaacaccctgaaggaaggggcctggggcaaggctagctaggcttcagctttcccttgccctaccccaggcctttttcttaaccccggagtgaccagaaaggatagaaagtagttctttctggattagtgttatatctccctctcaactagttctccccttccatcccctcatccctgcccctgccatctagactagggtccagatgagagacttctgagtgatggtagccataggattatcaacatccattgcctatgagtattaatggtgattgtctgtgggtattgatagttaattgtctgtgagtacctgacagcaacgggttatggctattgatgacaattggtaccttcagtgcccaagcatagccagattgtagcattgctccccgtactgctcctgggacaaatgctccttagagctgtaagaaggcctttgaaggtcctcagagactccaagcagatgcgggtcagtcaggtctgaaccaaagtactctaactgca

SEQ ID NO: 332365 - DNA, 528 bp, Homo sapiens
ataatttcttcctttttctttacagttttatcatttatgcatgtgttcctaaaatatatatttagcttgcttggctttgaacattatttgaatagaatcttcatatatgtatttatttgtgtgtcacttgcttctttggctaaacattatattcgtaagattatgttaatttattttgagatttttttaaacatctctgttgcttagaggactggagagtatgtttaccttttaccctcagtatggaaatttctgagtgagctatagtgtacagccatgctcctctctcagaaaagtcaaactgacaaaacaaacattgaaggtggttatttattttacaaaaatttcatcatagtagtcatttaaaatgactgggttaaaaataaaaacttagacagtgttttggaaattcttgtcaatggagttatattagaattgatttcacatggaggtcaaaagggagtgcatttgagggatggggaaaagaagagtgtaattagcatgaggattagggaggacagctggaga

SEQ ID NO: 332366 - DNA, 233 bp, Homo sapiens
ctactagggaggctgagacgagaggatcacttgaatacaggagttcaatgctgcagtgagctctgatcacactactacactccagcctaggtaatggagtgagaccatctctaaaaaattgttagatttttaagtgttttaaagtttttgaagagtagcacttgataaaagagttgtggcatggtggctcatactcataatttcagcactttgagaggctgaggcaggagcat

SEQ ID NO: 332367 - DNA, 341 bp, Homo sapiens
ctccaagtagaaatggacactaaactattaaatatattggctgaggctcgggagagagattattatataaataaacacaattttttaaaaagaaaaggaaatgactatgaaggagaaaggaaaacttttgaaacaactggaagaaaaggaggaatcaacagaggttttagtttatttgtttaagatgaaagagacctgaatgattataaattgtataaatagctagtccgaatgtgaagatgcagataattaggctatagaatggaaatgcgtttgaagataaggcaggatttgattgagagcttaatttgggagaaaatttgcctttagaaagaaggagc

SEQ ID NO: 332368 - DNA, 130 bp, Homo sapiens
tctgaggaggaagaggaggcgttggtcttgttgtttcaaggtggtggagatggaagggctggagcaggtggagggggagtcgggagaagcaggcccaattggtataacttgttttttttttttttttttt

SEQ ID NO: 332369 - DNA, 2923 bp, Homo sapiens
agcgggtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 332370 - DNA, 3184 bp, Homo sapiens
agcgggtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332371 - DNA, 3227 bp, Homo sapiens
agcgggtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactgtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332372 - DNA, 2923 bp, Homo sapiens
agcgggtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332373 - DNA, 1994 bp, Homo sapiens
atcacatttgaccattttattttcatgctttgtaggtatccttaaaatgtttattgagtgaatgagaaatttaatatatcagacttaaatgttatagaacatttaattaaaaccctttatattatgcttaatgtgtatattaactcctttaaaaatggtattttcttcaatgttaaggctgttcattttgggtatccatgacacttgctctaccagatgcctttagaggagtgagtttcctcccttagtaacaaaggaaagacttctcatattcattcatttattgtcattatttcctaagcaatgactataggccaggcactgagcatatagaatgaataatagtgcctttccctcaaatacaatggataatgaagccacagaaaatatattcaacaatgtttaatttatttgaccattgaggtgatagaagaaatgtaccacctcattaattttttagggggtggtgagcagggaggtatagtagaccatgatggataaataaactgtagatacctactgggatatctggtaagttttaccaactaataacacagataacataaagatttaatgcctctctcagtatgatttcttcacattcttttctgatctttttattttcctataagtatttctcatgtgtatttgattttattccagaaatattaataatatctagtatctagtattttgatttaaatgaatggtttggattcactgtatcaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332374 - DNA, 297 bp, Homo sapiens
aacttacataactgttaagaataacagtctgatttaataaatggttcattttaaaagttcatcagtgttgctctttgaataaaatgatttatcataatttatcaaatactgtatggtaggctttaaatagtgaatgaaaatttgaaaaacacttaggctacataatttcctcttaattgcacagcttcatattgtctactgtgtaaggtagcttttatgtcattttccccctaagttcataaactctgtatttctcaactgcttgtggttttaaattaaaacctcaacttgtcatct

SEQ ID NO: 332375 - DNA, 3084 bp, Homo sapiens
agcgggtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332376 - DNA, 3124 bp, Homo sapiens
agcggagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactgtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332377 - DNA, 3264 bp, Homo sapiens
agcggagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactaggtgttacaatccaaaatacatagttgtgatcatttataagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaaaaacaaaaaaaaaacaaaaacaaacacaaaaagacacacaaacaccacacacacaccccacccccacaacaaccacacaaacgccaaacaacacaacagaccagaaaacaaaagaaaggcagcgggggcaggcaaaaaatcactcgcgggggggcgagcagagaaacccacacccaccactctatgacagcaagcgcgagcccactagggagccatgacacacaagaacgcagccgcgccgtcaaacacacgcacagcggaagaaacgtgaattgggacatacggacagaccaactcgcggcgggggagcaaccgcaccacccaacagaacacgcgccggaaacaacacagcggggcggccacccactcgcgggcaacgacggataaataacgg

SEQ ID NO: 332378 - DNA, 1956 bp, Homo sapiens
agcgggtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtaattttctcagctccatgaaaagcattgctatagtagcattggaaactttctaaatatttaagacaaaaatgtgttccttatctataaaattttaggtgatcatgtttgtgtacaaatggcctttagaaagtaaa

SEQ ID NO: 332379 - DNA, 268 bp, Homo sapiens
ctgaaaatgggataacccatcaaagtactccaaagttggagccaagaaatgccgggctattgtattagtcttctcaagctgtcataataaaactacacagactggttggcttaaacaaaaattaattttcttacagttgtggagtcttaaaaaccaagatcgaggtaccagcaaagttcctttctcctgaggcctctcctcttggcttgtagatgggcatcttctcactgtgtcttcacatggtcgtcgacgcggccgcgaatttagt

SEQ ID NO: 332380 - DNA, 309 bp, Homo sapiens
actagtatcggagtttgtgtgcaaaacagcacataagtcaaataatcaggtgcagatgcatgttgttggtttggtgctttgggcactgtgcctggaacagtaatagtccattcccagttacctaggcacaactgggcacagaggctaacagaatgcagaaaccttcagatgattacaaacctaagcttggattacaccgtgcaacaacaacaaataaaacagtagacatatctccctgatctaattattattatgaaacaatgatcatctctgagatagttagttgaagggagataggcaagcgagtgt

SEQ ID NO: 332381 - DNA, 95 bp, Homo sapiens
acaggtggggttgaccttagttatttgtctgtaaaatgagagggttggacatgacagatgattttcagactctgatcccatcagaggatgctggg

SEQ ID NO: 332382 - DNA, 2583 bp, Homo sapiens
ctggcatcatgtggctgtgtagagctccagtgtgatttcaagccccctctaaaaactgccttagtctgcatgaagtagttaactctccaaagtgctttttgtctggcaaatcccttcacaattttcacctctcgtctaaaagcttccttaaaggaagccttccttgatcccttaggctaggttaggtttccagtctgtgttctcatagcactctgcactttttggttccttaaagcaactctgtgttattttttagaattttaatctgaatctcgtgtgtcacatacctaggtcagaaaatactggaacaatgaagttaagatttagtaattcaaattatgtaaaatgctcatatatatgtttttagattagcagctttatgatgccgatgctgaaggaacttttcaccccattcttacaagtctgctactgttttaagtgacatccttatagttgtagataagcaaatgtaaggttatatcaatgtgaagaagcccttagtatcacattttaaaatttatcatttagcaatatgacttttaaatttattgtttccgaatgagtgttgttgaggaatgttagcagtagtaaaatcttgtgttacaagatttttgcatttacatgaactttcactcatttttcagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatctaaaagaaacgatctcaggaccagaaaatgtctggattaggaagagtagcagaaaactgccccatcgaaatgcttctgctgcggctaagaaaaaattactgaatgtttataaagaggatgatacaaccataaattctgaaagtgaaaaagagctagaagatattaatagaaaaatgctttttttaagggggttcagatcctggaaagaaaatgcacaatagtgactatgagaatgtagaagtggcatctgaaaacaattggtacacaagtaaactggcagttacattctgctcccagctctaaaattactcccttattggcatctttggaggaattttctaaaagccataatccagtgggttcctcccagtcagctcttgtacagacatgtgctctggggaattctgaggaggaaataaattgcagagtctgtaggtggagaggtggaaagaaaagacaaatggcctgctataagactactattcctttccagaatgcaaggccttgaagacatgattccttagaggaagaatataatgggaagtgtacaggctaggaagaacttgaagtgaacaaatttcaaaatcttaacctgatgctaattttcagggttctccattacagtgtaaaaattcagaccacgacaactatggtgtcatgaggaaaaaaaatcaggcatttttccaaaggaagtgctaatgggcctatttgacttctgagtgaagcaaaaactacccagatccattccctacaattcacatccccaaaggtcaaaaacaaactaggaggacctgggaatttcagctggagatactgattattgagttctgaagtagagtgttggaaataggcaattagagaaagtccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaatatactgtcgcatctttttaacatagtaacgtgttactggaaaaattaagttgttgaaagtaagttgttttcccatttaaaaatatctgaatatatgatttgcatgtgtaaatctgaaaaactaaactacagaaacctagggttttctatttcttttttaagtcaaatgcatttttttttttgttatacagatgaaccaagtgtctaaaatacttgagaaatttgtggttgcatgtctgttttaaaaaaaaggctttttgttttttagcataagccagaatattctaacctactaagtctgtgtcctttgctccttttgtagtatactttcatctaaattactgatccccaatatgttgatacacaggtgagaaagggaagaattcctaataaactgctattacttttaggtgc

SEQ ID NO: 332383 - DNA, 656 bp, Homo sapiens
gcacatacatagttaaattacttacaaatctatttaaaaacctgttggaaacatattttattactttctttcctacttgataacatttctgctgtaaccaaaccttaagatcctgtgggaatggcttgtttgtcaatgggcaaaatttgtatgttgctgattggtgtgtaaaatgttaaatgcaacaacctagagtttcagaaaggcagcttggcaatatatatattatcactcttaaaaatgtttatgtatccaagacagattttcagaggaagaaatgcaagttttcaaaagaagaaataaaaactggaagaagggtttaacctcatggataataaaataaggaaataataatttttccttttcaatacttagccaattttgtgatttcgtttgtttttagctcaagaaagaattccacattttagcaagtggcaaagatgttggtttgttaacagttattcagattgctggtggggtgtgtgaagtggtccaggctttctaggggatattttgttaatagtagttgaaactgaaaaatatttggaacttttaattctgtgattttactcttctggtaatttggaaaacaagcagaaatgcttgtaaatatatgagtattgtagttcactcactgttgacagaaacaaagctgg

SEQ ID NO: 332384 - DNA, 873 bp, Homo sapiens
gcgctgcttgcctgtttttgtattgtgcttttggcttttttatctgtatcatatggtattttgtagattaaaaaaatgttaatgaatgttagcagagaaatgcctcagacttgatcatttctctcctaggtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggttagtagaaacctgctttcaaaatgtttaaaaagctatatttggcaatattgactagggtaaacaaagaaagagatagtggtagaattgggggctgattagcattttctgtttcattattctctttcattgtcagatggtgttagatgcctatgggtaggtgtgggtagggccaggcagaaaattgactaccatatttcaccctcgtttttttttcagtgattatttccatatcactgaaattttacttttattccacttatttcagtaaactttcactggtactttagtaa

SEQ ID NO: 332385 - DNA, 539 bp, Homo sapiens
atgcggcttagccagaaattgatctgcttgttttggcagtttgtttttacaaatcagcatattcaaagcctgctaaatattagacagctacatgtatatacgtacatacatgaaattctctgtatgactgatttatatgagggagacatttttaagttacctgttgagcattttatgtgcctgtgtgtttaaactggtaaaagtatggcaattgtaaaaactttttcactacttgaatttattgaaatattctataacaaattgaaatatttgataaatagaaatataaaaatagtaataaaataaaatgacattattaatattcaatattaaccaaatattacaatatttgattactccaatttcagtaaccttgggctgggtgtggtggctctgaactcctaacactttgggaggctgagacaggaggattgcttgagcccaggaattcaagtccagcctgggcaatgtagtgagacactctcttaaaaaaaaaaatcccaagatggttgaaatagagatcaaacatcattaggttt
